US010234465B2

(12) United States Patent
Young et al.

(10) Patent No.: US 10,234,465 B2
(45) Date of Patent: Mar. 19, 2019

(54) BCL6 EXPRESSION IN EUTOPIC ENDOMETRIUM AS A MARKER FOR ENDOMETRIOSIS AND SUBFERTILITY

(71) Applicants: The University of North Carolina at Chapel Hill, Chapel Hill, NC (US); Greenville Health System, Greenville, SC (US)

(72) Inventors: Steven Young, Durham, NC (US); Bruce Lessey, Greenville, SC (US)

(73) Assignees: The University of North Carolina at Chapel Hill, Chapel Hill, NC (US); Greenville Health Systems, Greenville, SC (US)

( * ) Notice: Subject to any disclaimer, the term of this patent is extended or adjusted under 35 U.S.C. 154(b) by 0 days.

(21) Appl. No.: 15/126,857

(22) PCT Filed: Mar. 19, 2015

(86) PCT No.: PCT/US2015/021584
§ 371 (c)(1),
(2) Date: Sep. 16, 2016

(87) PCT Pub. No.: WO2015/143228
PCT Pub. Date: Sep. 24, 2015

(65) Prior Publication Data
US 2017/0089923 A1    Mar. 30, 2017

Related U.S. Application Data

(60) Provisional application No. 61/955,300, filed on Mar. 19, 2014.

(51) Int. Cl.
| | | |
|---|---|---|
| *G01N 33/68* | (2006.01) | |
| *G06F 19/00* | (2018.01) | |
| *G06F 19/24* | (2011.01) | |
| *G16H 50/30* | (2018.01) | |
| *C12Q 1/6883* | (2018.01) | |

(52) U.S. Cl.
CPC ....... *G01N 33/6893* (2013.01); *C12Q 1/6883* (2013.01); *G01N 33/689* (2013.01); *G06F 19/00* (2013.01); *G06F 19/24* (2013.01); *G16H 50/30* (2018.01); *C12Q 2600/106* (2013.01); *C12Q 2600/158* (2013.01); *G01N 2800/364* (2013.01); *G01N 2800/367* (2013.01); *G01N 2800/52* (2013.01); *Y02A 90/26* (2018.01)

(58) Field of Classification Search
None
See application file for complete search history.

(56) References Cited

U.S. PATENT DOCUMENTS

| | | |
|---|---|---|
| 4,981,785 A | 1/1991 | Nayak |
| 5,358,691 A | 10/1994 | Clark et al. |
| 5,478,725 A * | 12/1995 | Lessey .................. A61D 19/04 435/7.21 |
| 5,599,677 A | 2/1997 | Dowell et al. |
| 5,672,480 A | 9/1997 | Dowell et al. |
| 5,885,530 A | 3/1999 | Babson et al. |
| 6,159,750 A | 12/2000 | Edmonds |
| 7,871,778 B2 | 1/2011 | Giudice |
| 8,247,174 B2 | 8/2012 | Giudice |
| 2003/0113746 A1 | 6/2003 | Leyendecker |
| 2004/0152141 A1 | 8/2004 | Lessey |
| 2005/0164272 A1 | 7/2005 | Warrington et al. |
| 2011/0171631 A1* | 7/2011 | Giudice ............... C12Q 1/6883 435/6.1 |

FOREIGN PATENT DOCUMENTS

WO    WO 2007/057648 A1    5/2007

OTHER PUBLICATIONS

Leandro Cerchietti and Ari Melnick, Expert Rev Hematol. 2013; 6: 343-345; Author Manuscript. (Year: 2013).*
Cardenas et al., J Clin Invest. 2016; 126: 3351-3362. doi:10.1172/JCI85795. (Year: 2016).*
Phillips, A., J Pharm Pharmacology, 2001; 53: 1169-1174 (Year: 2001).*
Vidal et al., European Journal of Cancer, 2005; 41: 2812-2818 (Year: 2005).*
Pirollo et al., Cancer Res. 2008; 68(5): 1247-1250 (Year: 2008).*
Winkler, Ther. Deliv. 2013; 4: 791-809 (Year: 2013).*
Young et al., "B-cell lymphoma protein 6 (BCL-6): A novel diagnostic marker for endometriosis"; In: Fertility and Sterility, (Sep. 2014) vol. 102, No. 3, Suppl. 1, pp. e11. Abstract No. O-28. The 70th Annual Meeting of the American Society for Reproductive Medicine, ASRM 2014. Honolulu, HI (Year: 2014).*
GenBank Accession No. AAA35927 "plate glycoprotein IIIa (GPIIIa) [*Homo sapiens*]" NCBI (2 pages) (Jun. 11, 1993).
GenBank Accession No. AAD51953 "glycoprotein IIIa [Sus scrofa]" NCBI (2 pages) (Aug. 31, 1999).
GenBank Accession No. AAI66425 "B-cell CLL/lymphoma 6 [Rattus norvegicus]" NCBI (3 pages) (Mar. 18, 2009).

(Continued)

Primary Examiner — Christina M Borgeest
(74) Attorney, Agent, or Firm — Myers Bigel, P.A.

(57) ABSTRACT

Methods for identifying subjects as candidates for embryo implantation are provided. In some embodiments, the methods include providing a sample of endometrium isolated from a subject during the second half of the subject's menstrual cycle and determining whether the subject is a candidate based on the expression of BCL6 in the sample. Also provided are methods for identifying an increased risk for implantation failure subsequent to in vitro fertilization (IVF) and/or frozen embryo transfer (FET), methods for detecting endometrial receptivity, methods for facilitating diagnoses of infertility, methods for increasing the likelihood of embryo implantation, methods for detecting the presence of endometriosis, and methods for managing treatment of subjects with potential endometriosis, subfertility, or both.

24 Claims, 15 Drawing Sheets

Specification includes a Sequence Listing.

(56) References Cited

OTHER PUBLICATIONS

GenBank Accession No. AF170527 "Sus scrofa glycoprotein IIIa (GPIIIa) mRNA, complete cds" *NCBI* (2 pages) (Aug. 31, 1999).
GenBank Accession No. AK036975 "Mus musculus adult female vagina cDNA, RIKEN full-length enriched library, clone:9930032A10 product:B-cell leukemia/lymphoma 6, full insert sequence" *NCBI* (4 pages) (Oct. 6, 2010).
GenBank Accession No. AK039228 "Mus musculus adult male spinal cord cDNA, Riken full-length enriched library, clone:A330001J07 product:B-cell leukemia/lymphoma 6, full insert sequence" *NCBI* (4 pages) (Oct. 6, 2010).
GenBank Accession No. BAC29654 "unnamed protein product [Mus musculus]" *NCBI* (5 pages) (Oct. 6, 2010).
GenBank Accession No. BAC30286 "unnamed protein product [Mus musculus]" *NCBI* (5 pages) (Oct. 6, 2010).
GenBank Accession No. BC166425 "Rattus norvegicus B-cell CLL/lymphoma 6, mRNA (cDNA clone IMGE:187400 Image:7097735), complete cds" *NCBI* (3 pages) (Mar. 18, 2009).
GenBank Accession No. M35999 "Human platelet glycoprotein IIIa (GPIIIa) mRNA, complete cds" *NCBI* (2 pages) (Jun. 11, 1993).
GenBank Accession No. NM_000212 "*Homo sapiens* integrin subunit beta 3 (ITGB3), mRNA" *NCBI* (7 pages) (Jun. 4, 2017).
GenBank Accession No. NM_001003162 "Canis lupus familiaris integrin subunit beta 3 (ITGB3), mRNA" *NCBI* (2 pages) (Aug. 9, 2016).
GenBank Accession No. NM_001081802 "Equus caballus integrin subunit beta 3 (ITGB3), mRNA" *NCBI* (2 pages) (Aug. 9, 2016).
GenBank Accession No. NM_001107084 "Rattus norvegicus B-cell CLL/lymphoma 6 (Bcl6), mRNA" *NCBI* (3 pages) (Jun. 25, 2017).
GenBank Accession No. NM_001159790 "Pongo abelii B-cell CLL/lymphoma 6 (BCL6), mRNA" *NCBI* (2 pages) (Apr. 18, 2013).
GenBank Accession No. NM_001206450 "Bos taurus B-cell CLL/lymphoma 6 (BCL6), mRNA" *NCBI* (3 pages) (Apr. 24, 2016).
GenBank Accession No. NM_001206490 "Bos taurus integrin subunit beta 3 (ITGB3), mRNA" *NCBI* (4 pages) (Sep. 1, 2016).
GenBank Accession No. NM_009744 "Mus musculus B cell leukemia/lymphoma 6 (Bcl6), transcript variant 1, mRNA" *NCBI* (5 pages) (Jun. 26, 2017).
GenBank Accession No. NM_214002 "Sus scrofa integrin subunit beta 3 (ITGB3), mRNA" NCBI (4 pages) (Aug. 9, 2016).
GenBank Accession No. NP_000203 "integrin beta-3 precursor [*Homo sapiens*]" NCBI (4 pages) (Jun. 4, 2017).
GenBank Accession No. NP_001003162 "integrin beta-3 precursor [Canis lupus familiaris]"*NCBI* (2 pages) (Aug. 9, 2016).
GenBank Accession No. NP_001075271 "integrin beta-3 precursor [Equus caballus]" *NCBI* (2 pages) (Aug. 9, 2016).
GenBank Accession No. NP_001100554 "B-cell lymphoma 6 protein [Rattus norvegicus]" NCBI (3 pages) (Jun. 25, 2017).
GenBank Accession No. NP_001153262 "B-cell lymphoma 6 protein [Pongo abelii]" NCBI (2 pages) (Apr. 18, 2013).
GenBank Accession No. NP_001193379 "B-cell lymphoma 6 protein [Bos Taurus]" NCBI (3 pages) (Apr. 24, 2016).
GenBank Accession No. NP_001193419 "integrin beta-3 precursor [Bos taurus]" NCBI (2 pages) (Sep. 1, 2016).
GenBank Accession No. Np 033874 "B-cell lymphoma 6 protein homolog [Mus musculus]" NCBI (4 pages) (Jun. 26, 2017).
GenBank Accession No. NP_999167 "integrin beta-3 precursor [Sus scrofa]" NCBI (3 pages) (Aug. 9, 2016).
GenBank Accession No. XM_001116013 "PREDICTED: Macaca mulatta integrin, beta 3 (platelet glycoprotein IIIa, antigen CD61), transcript variant 2 (ITGB3), mRNA" NCBI (3 pages) (Jun. 1, 2010).
GenBank Accession No. XM_001158812 "PREDICTED: Pan troglodytes B-cell CLL/lymphoma 6 (BCL6), transcript variant X2, mRNA" NCBI (3 pages) (Jun. 2, 2016).
GenBank Accession No. XM_001499782 "PREDICTED: Equus caballus B-cell CLL/ymphoma 6 (BCL6), transcript variant X2, mRNA" NCBI (2 pages) (Nov. 20, 2015).

GenBank Accession No. XM_002834317 "PREDICTED: Pongo abelii integrin, beta 3 (platelet glycoprotein IIIa, antigen CD61) (ITGB3), transcript variant X1, mRNA" NCBI (2 pages) (Sep. 23, 2014).
GenBank Accession No. XM_003363354 "PREDICTED: Equus caballus B-cell CLL/lymphoma 6 (BCL6), transcript variant X1, mRNA" NCBI (3 pages) (Nov. 20, 2015).
GenBank Accession No. XM_003824955 "PREDICTED: Pan paniscus B-cell CLL/lymphoma 6 (BCL6), transcript variant X1, mRNA" NCBI (3 pages) (Sep. 30, 2015).
GenBank Accession No. XM_003927003 "PREDICTED: Saimiri boliviensis boliviensis B-cell CLL/lymphoma 6 (BCL6), transcript variant X1, mRNA" NCBI (3 pages) ( Nov. 24, 2014).
GenBank Accession No. XM_003991804 "PREDICTED: Felis catus B-cell CLL/lymphoma 6 (BCL6), transcript variant X1, mRNA" NCBI (2 pages) (Dec. 29, 2016).
GenBank Accession No. XM_003997035 "PREDICTED: Felis catus integrin subunit beta 3 (ITGB3), transcript variant X2, mRNA" NCBI (3 pages) (Dec. 29, 2016).
GenBank Accession No. XM_004038190 "PREDICTED: Gorilla gorilla gorilla B-cell CLL/lymphoma 6 (BCL6), transcript variant X1, mRNA" NCBI (3 pages) (Nov. 4, 2016).
GenBank Accession No. XM_004041453 "PREDICTED: Gorilla gorilla gorilla integrin subunit beta 3 (ITGB3),mRNA" NCBI (2 pages) (Nov. 4, 2016).
GenBank Accession No. XM_004275670 "PREDICTED: Orcinus orca integrin, beta 3 (platelet glycoprotein IIIa, antigen CD61) (ITGB3), mRNA" NCBI (3 pages) (May 15, 2015).
GenBank Accession No. XM_004275671 "PREDICTED: Orcinus orca integrin, beta 3 (platelet glycoprotein IIIa, antigen CD61), transcript variant 2 (ITGB3), mRNA" NCBI (2 pages) (Mar. 18, 2013).
GenBank Accession No. XM_004278481 "PREDICTED: Orcinus orca B-cell CLL/lymphoma 6, transcript variant 1 (BCL6), mRNA" NCBI (3 pages) (Mar. 18, 2013).
GenBank Accession No. XM_004278482 "PREDICTED: Orcinus orca B-cell CLL/lymphoma 6 (BCL6), transcript variant X2, mRNA" NCBI (3 pages) (May 15, 2015).
GenBank Accession No. XM_005201513 "PREDICTED: Bos taurus B-cell Cu/lymphoma 6 (BCL6), transcript variant X7I, mRNA" NCBI (2 pages) (Jan. 26, 2016).
GenBank Accession No. XM_005584610 "PREDICTED: Macaca fascicularis integrin subunit beta 3 (ITGB3), mRNA" NCBI (2 pages) (Jan. 25, 2016).
GenBank Accession No. XM_005601882 "PREDICTED: Equus caballus B-cell CLL/lymphoma 6 (BCL6), transcript variant X3, mRNA" NCBI (3 pages) (Nov. 20, 2015).
GenBank Accession No. XM_005624174 "Predicted: Canis lupus familiaris integrin, beta 3 (platelet glycoprotein IIIa, antigen CD61) (ITGB3), transcript variant X1, mRNA" NCBI, (3 pages) (Sep. 17, 2015).
GenBank Accession No. XM_005639719 "PREDICTED: Canis lupus familiaris B-cell CLL/lymphoma 6 (BCL6), transcript variant X1, mRNA" NCBI (3 pages) (Sep. 17, 2015).
GenBank Accession No. XM_005639720 "PREDICTED: Canis lupus familiaris B-cell CLL/lymphoma 6 (BCL6),transcript variant X2, mRNA" NCBI (3 pages) (Sep. 17, 2015).
GenBank Accession No. XM_005639722 "PREDICTED: Canis lupus familiaris B-cell CLL/lymphoma 6 (BCL6), transcript variant X3, mRNA" NCBI (3 pages) (Sep. 17, 2015).
GenBank Accession No. XM_006936189 "PREDICTED: Felis catus B-cell CLL/lymphoma 6 (BCL6), transcript variant X2, mRNA" NCBI (3 pages) (Dec. 29, 2016).
GenBank Accession No. XM_006936190 "PREDICTED: Felis catus B-cell CLL/lymphoma 6 (BCL6), transcript variant X3, mRNA" NCBI (2 pages) (Dec. 29, 2016).
GenBank Accession No. XM_008009503 "PREDICTED: Chlorocebus sabaeus B-cell CLL/lymphoma 6 (BCL6), transcript variant X1, mRNA" NCBI (3 pages) (May 14, 2014).
GenBank Accession No. XM_008009504 "PREDICTED: Chlorocebus sabaeus B-cell CLL/lymphoma 6 (BCL6), transcript variant X2, mRNA" NCBI (3 pages) (May 14, 2014).

(56) References Cited

OTHER PUBLICATIONS

GenBank Accession No. XM_008009507 "PREDICTED: Chlorocebus sabaeus B-cell CLL/lymphoma 6 (BCL6), transcript variant X4, mRNA" NCBI (4 pages) (May 14, 2014).
GenBank Accession No. XM_008012292 "PREDICTED: Chlorocebus sabaeus integrin, beta 3 (platelet glycoprotein IIIa, antigen CD61) (ITGB3), transcript variant X1,mRNA" NCBI (3 pages) (May 14, 2014).
GenBank Accession No. XM_008012293 "PREDICTED: Chlorocebus sabaeus integrin, beta 3 (platelet glycoprotein IIIa, antigen CD61) (ITGB3), transcript variant X2, mRNA" NCBI (3 pages) (May 14, 2014).
GenBank Accession No. XM_008768799 "PREDICTED: Rattus norvegicus B-cell CLL/lymphoma 6 (Bcl6), transcript variant X1, mRNA" NCBI (3 pages) (Aug. 7, 2014).
GenBank Accession No. XM_008961749 "PREDICTED: Pan paniscus integrin, beta 3 (platelet glycoprotein IIIa, antigen CD61) (ITGB3), mRNA" NCBI (2 pages) (Sep. 30, 2015).
GenBank Accession No. XM_008978646 "PREDICTED: Pan paniscus B-cell CLL/lymphoma 6 (BCL6), transcript variant X2, mRNA" NCBI (3 pages) (Sep. 30, 2015).
GenBank Accession No. XM_008978648 "PREDICTED: Pan paniscus B-cell CLLl/lymphoma 6 (BCL6), transcript variant X4, mRNA" NCBI (5 pages) (Sep. 30, 2015).
GenBank Accession No. XM_009236637 "PREDICTED: Pongo abelii integrin, beta 3 (platelet glycoprotein IIIa, antigen CD61) (ITGB3), transcript variant X2, mRNA" NCBI (2 pages) (Sep. 23, 2014).
GenBank Accession No. XM_009446989 "PREDICTED: Pan troglodytes B-cell CLL/lymphoma 6 (BCL6), transcript variant X1, mRNA" NCBI (4 pages) (Jun. 2, 2016).
GenBank Accession No. XM_009446993 "PREDICTED: Pan troglodytes B-cell CLL/lymphoma 6 (BCL6), transcript variant X7, mRNA" NCBI (3 pages) (Jun. 2, 2016).
GenBank Accession No. XM_010330277 "PREDICTED: Saimiri boliviensis boliviensis integrin, beta 3 (platelet glycoprotein IIIa, antigen CD61) (ITGB3), transcript variant X1, mRNA" NCBI (2 pages) (Nov. 24, 2014).
GenBank Accession No. XM_010330278 "PREDICTED: Saimiri boliviensis boliviensis integrin, beta 3 platelet glycoprotein IIIa, antigen CD61) (ITGB3), transcript variant X2, RNA" NCBI (2 pages) (Nov. 24, 2014).
GenBank Accession No. XM_010337712 "PREDICTED: Saimiri boliviensis boliviensis B-cell CLL/lymphoma 6 (BCL6), transcript variant X2, mRNA" NCBI (4 pages) (Nov. 24, 2014).
GenBank Accession No. XM_010337713 "PREDICTED: Saimiri boliviensis boliviensis B-cell CLL/lymphoma 6 (BCL6), transcript variant X3, mRNA" NCBI (3 pages) (Nov. 24, 2014).
GenBank Accession No. XM_523684 "PREDICTED: Pan troglodytes integrin subunit beta 3 (ITGB3), transcript variant X1, mRNA" NCBI (3 pages) (Jun. 2, 2016).
GenBank Accession No. XP_001116013 "PREDICTED: integrin beta-3-like isoform 2 [Macaca mulatta]" NCBI (2 pages) (Jun. 1, 2010).
GenBank Accession No. XP_001158812 "PREDICTED: B-cell lymphoma 6 protein [Pan troglodytes]" NCBI (3 pages) (Jun. 2, 2016).
GenBank Accession No. XP_001499832 "PREDICTED: B-cell lymphoma 6 protein isoform X1 [Equus caballus]" NCBI (3 pages) (Nov. 20, 2015).
GenBank Accession No. XP_002834363 "PREDICTED: integrin beta-3 isoform X1 [Pongo abelii]" NCBI (2 pages) (Sep. 23, 2014).
GenBank Accession No. XP_003363402 "PREDICTED: B-cell lymphoma 6 protein isoform X1 [Equus caballus]" NCBI (3 pages) (Nov. 20, 2015).
GenBank Accession No. XP_003825003 "PREDICTED: B-cell lymphoma 6 protein [Pan paniscus]" NCBI (3 pages) (Sep. 30, 2015).
GenBank Accession No. XP_003927052 "PREDICTED: B-cell lymphoma 6 protein[Saimiri boliviensis boliviensis]" NCBI (3 pages) (Nov. 24, 2014).
GenBank Accession No. XP_003991853 "PREDICTED: B-cell lymphoma 6 protein [Felis catus]" NCBI (3 pages) (Dec. 29, 2016).
GenBank Accession No. XP_003997084 "PREDICTED: integrin beta-3 isoform X2 [Felis catus]" NCBI (2 pages) (Dec. 29, 2016).
GenBank Accession No. XP_004038238 "PREDICTED: B-cell lymphoma 6 protein isoform X1 [Gorilla gorilla gorilla]" NCBI (3 pages) (Nov. 4, 2016).
GenBank Accession No. XP_004041501 "PREDICTED: integrin beta-3 [Gorilla gorilla gorilla]" NCBI (2 pages) (Nov. 4, 2016).
GenBank Accession No. XP_004275718 "PREDICTED: integrin beta-3 [Orcinus orca]" NCBI (2 pages) (May 15, 2015).
GenBank Accession No. XP_004275719 "PREDICTED: integrin beta-3 isoform 2 [Orcinus orca]" NCBI (2 pages) (Mar. 18, 2013).
GenBank Accession No. XP_004278529 "PREDICTED: B-cell lymphoma 6 protein isoform 1 [Orcinus orca]" NCBI (2 pages) (Mar. 18, 2013).
GenBank Accession No. XP_004278530 "PREDICTED: B-cell lymphoma 6 protein [Orcinus orca]" NCBI (3 pages) (May 15, 2015).
GenBank Accession No. XP_005201570 "PREDICTED: B-cell lymphoma 6 protein isoform X1 [Bos taurus]" NCBI (3 pages) (Jan. 26, 2016).
GenBank Accession No. XP_005584667 "PREDICTED: integrin beta-3 [Macaca fascicularis]" NCBI (2 pages) (Jan. 25, 2016).
GenBank Accession No. XP_005601939 "PREDICTED: B-cell lymphoma 6 protein isoform X1 [Equus caballus]" NCBI (3 pages) (Nov. 20, 2015).
GenBank Accession No. XP_005624231 "PREDICTED: integrin beta-3 isoform X1 [Canis lupus familiaris]" NCBI (2 pages) (Sep. 17, 2015).
GenBank Accession No. XP_005639776 "PREDICTED: B-cell lymphoma 6 protein isoform X1 [Canis lupus familiaris]" NCBI (3 pages) (Sep. 17, 2015).
GenBank Accession No. XP_005639777 "PREDICTED: B-cell lymphoma 6 protein isoform X1 [Canis lupus familiaris]" NCBI (3 pages) (Sep. 17, 2015).
GenBank Accession No. XP_005639779 "PREDICTED: B-cell lymphoma 6 protein isoform X1 [Canis lupus familiaris]" NCBI (3 pages) (Sep. 17, 2015).
GenBank Accession No. XP_006936251 "PREDICTED: B-cell lymphoma 6 protein [Felis catus]" NCBI (3 pages) (Dec. 29, 2016).
GenBank Accession No. XP_006936252 "PREDICTED: B-cell lymphoma 6 protein [Felis catus]" NCBI (3 pages) (Dec. 29, 2016).
GenBank Accession No. XP_008007694 "PREDICTED: B-cell lymphoma 6 protein [Chlorocebus sabaeus]" NCBI (3 pages) (May 14, 2014).
GenBank Accession No. XP_008007695 "PREDICTED: B-cell lymphoma 6 protein [Chlorocebus sabaeus]" NCBI (3 pages) (May 14, 2014).
GenBank Accession No. XP_008007698 "PREDICTED: B-cell lymphoma 6 protein [Chlorocebus sabaeus]" NCBI (3 pages) (May 14, 2014).
GenBank Accession No. XP_008010483 "PREDICTED: integrin beta-3 isoform X1 [Chlorocebus sabaeus]" NCBI (2 pages) (May 14, 2014).
GenBank Accession No. XP_008010484 "PREDICTED: integrin beta-3 isoform X2 [Chlorocebus sabaeus]" NCBI (2 pages) (May 14, 2014).
GenBank Accession No. XP_008767021 "PREDICTED: B-cell lymphoma 6 protein isoform X1 [Rattus norvegicus]" NCBI (2 pages) (Aug. 7, 2014).
GenBank Accession No. XP_008959997 "PREDICTED: integrin beta-3 [Pan paniscus]" NCBI (2 pages) (Sep. 30, 2015).
GenBank Accession No. XP_008976894 "PREDICTED: B-cell lymphoma 6 protein [Pan paniscus]" NCBI (3 pages) (Sep. 30, 2015).
GenBank Accession No. XP_008976896 "PREDICTED: B-cell lymphoma 6 protein [Pan paniscus]"NCBI (3 pages) (Sep. 30, 2015).

(56) References Cited

OTHER PUBLICATIONS

GenBank Accession No. XP_009234912 "PREDICTED: integrin beta-3 isoform X2 [Pongo abelii]" NCBI (2 pages) (Sep. 23, 2014).
GenBank Accession No. XP_009445264 "PREDICTED: B-cell lymphoma 6 protein [Pan troglodytes]" NCBI (3 pages) (Jun. 2, 2016).
GenBank Accession No. XP_009445268 "PREDICTED: B-cell lymphoma 6 protein [Pan troglodytes]" NCBI (3 pages) (Jun. 2, 2016).
GenBank Accession No. XP_010328579 "PREDICTED: integrin beta-3 isoform X1 [Saimiri boliviensis boliviensis]"NCBI (2 pages) (Nov. 24, 2014).
GenBank Accession No. XP_010328580 "PREDICTED: integrin beta-3 isoform X2 [Saimiri boliviensis boliviensis]" NCBI (2 pages) (Nov. 24, 2014).
GenBank Accession No. XP_010336014 "PREDICTED: B-cell lymphoma 6 protein [Saimiri boliviensis boliviensis]" NCBI (3 pages) (Nov. 24, 2014).
GenBank Accession No. XP_010336015 "PREDICTED: B-cell lymphoma 6 protein [Saimiri boliviensis boliviensis]" NCBI (3 pages) (Nov. 24, 2014).
GenBank Accession No. XP_523684 "PREDICTED: integrin beta-3 isoform X1 [Pan troglodytes]" NCBI (2 pages) (Jun. 2, 2016).
Adamson et al. "Creating solutions in endometriosis: global collaboration through the World Endometriosis Research Foundation" *J Endometriosis* 2:3-6 (2010).
Aghajanova et al. "Altered gene expression profiling in endometrium: evidence for progesterone resistance" *Semin Reprod Med* 28:51-58 (2010) (Abstract Only).
Arici et al. "The effect of endometriosis on implantation: results from the Yale University in vitro fertilization and embryo transfer program" *Fertil Steril* 65:603-607 (1996).
Barnhart et at. "Effect of endometriosis on in vitro fertilization" *Fertil Steril* 77:1148-1155 (2002).
Bird et al. "Single-chain antigen-binding proteins" *Science* 242:423-426 (1988) (Abstract Only).
Budwit-Novotny et at "Immunohistochemical analyses of estrogen receptor in endometrial adenocarcinoma using a monoclonal antibody" *Cancer Res* 46:5419-5425 (1986).
Burney et at "MicroRNA expression profiling of eutopic secretory endometrium in women with versus without endometriosis" *Mol Hum Reprod* 15:625-631 (2009).
Chaouat et al. "Cytokines: Important for implantation?" *J Assist Reprod Genet* 24:491-505 (2007).
Creus et al. "$\alpha v \beta 3$ integrin expression and pinopod formation in normal and out-of-phase endometria of fertile and infertile women" *Hum Reprod* 17:2279-2286 (2002).
Franasiak et al. "Prospective assessment of midsecretory endometrial leukemia inhibitor factor expression versus $\alpha v \beta 3$ testing in women with unexplained infertility" *Fertil Steril* 101:1724-1731 (2014).
Giudice "Clinical Practice. Endometriosis" *N Engl J Med* 362:2389-2398 (2010).
Hahn et al. "Experimental evidence for failure to implant as a mechanism of infertility associated with endometriosis" *Am J Obstet Gynecol* 155:1109-11-13 (1986) (Abstract Only).
Holoch & Lessey "Endometriosis and Infertility" *Clin Obstet Gynecol* 53:429-438. (2010) (Abstract Only).
Hunkapiller & Hood "The growing immunoglobulin gene superfamily" *Nature* 323:15-16 (1986).
Huston et al. "Protein engineering of antibody binding sites: recovery of specific activity in an anti-digoxin single-chain Fv analogue produced in *Escherichia coli*." *Proc Natl Acad Sci USA* 85:5879-5883 (1988).
Irwin et al. "Growth factors and decidualization in vitro" *Ann N Y Acad Sci* 734:7-18 (1994).
Kojima et al. "Testicular germ cell apoptosis in Bcl6-deficient mice" *Development* 128:57-65 (2001).
Kumagai etal. "The proto-oncogene Bcl6 inhibits apoptotic cell death in differentiation-induced mouse myogenic cells" *Oncogene* 18:467-475 (1999).
Lanzavecchia et al. "The use of hybrid hybridomas to target human cytotoxic T lymphocytes" *Eur J Immunol* 17:105-111 (1987).
Large & Demayo "The regulation of embryo implantation and endometrial decidualization by progesterone receptor signaling" *Mol Cell Endocrinol* 358:155-165 (2012) (Abstract Only).
Lessey & Young "Homeostasis imbalance in the endometrium of women with implantation defects: the role of estrogen and progesterone" *Semin Reprod Med* 32:365-375 (2014) (Abstract Only).
Lessey et al. "Integrin adhesion molecules in the human endometrium. Correlation with the normal and abnormal menstrual cycle" *J Clin Invest* 90:188-195 (1992).
Lessey etal. "Aberrant integrin expression in the endometrium of women with endometriosis" *J Clin Endocrinol Metabol* 79:643-649 (1994) (Abstract Only).
Lessey et al. "Further characterization of endometrial integrins during the menstrual cycle and in pregnancy" *Fertil Steril* 62:497-506 (1994).
Lessey et al. "Integrins as markers of uterine receptivity in women with primary unexplained infertility" *Fertil Steril* 63:535-542 (1995).
Lessey et al. "Eutopic endometrium in women with endometriosis: ground zero for the study of implantation defects" *Semin Reprod Med* 31:109-124 (2013) (Abstract Only).
Meyer et al. "Hydrosalpinges adversely affect markers of endometrial receptivity" *Hum Reprod* 12:1393-1398 (1997).
Miller et al. "Endometrial receptivity defects during IVF cycles with and without letrozole" *Hum Reprod* 27:881-888 (2012).
Navot et al. "An insight into early reproductive processes through the in vivo model of ovum donation" *J Clin Endocrinol Metab* 72:408-414 (1991) (Abstract Only).
Noyes et al. "Dating the endometrial biopsy" *Fertil Steril* 1:3-25 (1950).
Olive & Schwartz, "Endometriosis" *N Engl J Med* 328:1759-1769 (1993) (Abstract Only).
Plante et al. "G protein-coupled estrogen receptor (GPER) expression in normal and abnormal endometrium" *Reprod Sci* 19:684-693 (2012).
Popovici et al. "Discovery of new inducible genes in in vitro decidualized human endometrial stromal cells using microarray technology" *Endocrinology* 141:3510-3513 (2000).
Ryan et al. "Isolation, characterization, and comparison of human endometrial and endometriosis cells in vitro" *J Clin Endocrinol Metab* 78:642-649 (1994) (Abstract Only).
Shaffer et al. "BCL6 represses genes that function in lymphocyte differentiation, inflammation, and cell cycle control" *Immunity* 13:199-212 (2000).
Simón et al. "Outcome of patients with endometriosis in assisted reproduction: results from in-vitro fertilization and oocyte donation" *Hum Reprod* 9:725-729 (1994).
Strathy et al. "Endometriosis and infertility: a laparoscopic study of endometriosis among fertile and infertile women" *Fertil Steril* 38:667-672 (1982).
Takeda etal. "Bcl6 is a transcriptional repressor for the IL-18 gene" *J Immunol* 171:426-431 (2003).
Talbi etal. "Molecular phenotyping of human endometrium distinguishes menstrual cycle phases and underlying biological processes in normo-ovulatory women" *Endocrinol* 147:1097-1121 (2006).
Tiberi et-al. "A BCL6/BCOR/SIRT1 Complex Triggers Neurogenesis and Suppresses Medulloblastoma by Repressing Sonic Hedgehog Signaling" *Cancer Cell* 26:797-812 (2014).
Wei et al. "Indian Hedgehog and its targets in human endometrium: menstrual cycle expression and response to CDB-2914" *J Cim Endocrinol Metab* 95:5330-5337 (2010).
Yu et al. "BCL6 negatively regulates macrophage proliferation by suppressing autocrine IL-6 production" *Blood* 105:1777-1784 (2005).
International Search Report and Written Opinion Corresponding to International Application No. PCT/US15/21584; dated Jul. 2, 2015; 19 pages.

* cited by examiner

BCL6 EXPRESSION IN EUTOPIC ENDOMETRIUM AS A MARKER FOR ENDOMETRIOSIS AND SUBFERTILITY

CROSS REFERENCE TO RELATED APPLICATION

This application claims the benefit of U.S. Provisional Patent Application Ser. No. 61/955,300, filed Mar. 19, 2014, the disclosure of which is incorporated herein by reference in its entirety

GOVERNMENT INTEREST

This invention was made with government support under Grant Number HD067721 awarded by the National Institutes of Health. The government has certain rights in the invention.

TECHNICAL FIELD

The presently disclosed subject matter pertains in some embodiments to methods and compositions for use in the detection and management of treatment of endometriosis and/or subfertility. Also provided are methods, compositions, and kits for use in the assessing the likelihood of successful implantation of in vitro fertilized ova and/or frozen embryos.

BACKGROUND

Endometriosis, the presence of viable endometrial tissue outside the uterine cavity (its usual location), affects about 2-8% of women in the general population and 30-50% of women with infertility (Strathy et al., 1982; Verkauf 1987) and is a major cause of pelvic pain and infertility. However, both pain and infertility are non-specific symptoms of many disorders and there is currently no generally useful test for endometriosis except surgical examination.

Despite the lack of diagnostic tests, once diagnosis is made there are effective treatments. Surgical therapy for endometriosis can relieve pain, but given the lack of symptom specificity, physicians are reluctant to perform possibly unnecessary surgery, leading to delays in diagnosis and progression of the disease. An even greater problem is the uncertainty surrounding endometriosis and infertility. Only about half of women with endometriosis meet the diagnostic criteria for infertility and there is no test to know whether a patient's fertility will benefit from surgical therapy of endometriosis. Furthermore, many of the women with endometriosis-related infertility have no other symptoms. In fact, it has been calculated that the number of women with possible endometriosis who need to undergo surgery in order to help one conceive (number needed to treat (NNT)) is about 12. Furthermore, surgery can delay fertility treatments due at least in part to various limitations impose pre- and post-operatively.

Provided herein is a sensitive test for endometriosis and/or subfertility. Also provided are additional methods for managing treatment of subjects with endometriosis and subfertility. Such tests and methods avoid delays in diagnosis and ineffective treatment and/or reduce the need for invasive procedures. Further provided are methods for assessing the likelihood of successful implantation of in vitro fertilized ova and/or frozen embryos.

SUMMARY

This Summary lists several embodiments of the presently disclosed subject matter, and in many cases lists variations and permutations of these embodiments. This Summary is merely exemplary of the numerous and varied embodiments. Mention of one or more representative features of a given embodiment is likewise exemplary. Such an embodiment can typically exist with or without the feature(s) mentioned; likewise, those features can be applied to other embodiments of the presently disclosed subject matter, whether listed in this Summary or not. To avoid excessive repetition, this Summary does not list or suggest all possible combinations of such features.

In some embodiments, the presently disclosed subject matter provides methods for identifying subject as candidate for implantation of embryos. In some embodiments, the methods comprise (a) providing a sample of endometrium from a subject, wherein the sample comprises endometrium isolated from the subject during the second half of the subject's menstrual cycle; (b) detecting a level of expression of a BCL6 gene product in the sample; (c) correlating the expression level of the BCL6 gene product in the sample with endometrial receptivity, wherein overexpression of the BCL6 gene product in the sample as compared to expression of the BCL6 gene product in a sample of similarly timed endometrium isolated from a normally fertile control subject is indicative of reduced receptivity of the endometrium in the subject; and (d) determining whether the subject is a candidate for implantation of an embryo based on the correlating step, wherein the determining step identifies the subject as a candidate for implantation of an embryo. In some embodiments, the sample is a biopsy sample, optionally a formalin fixed, paraffin embedded biopsy section thereof. In some embodiments, the detecting step comprises staining the sample with a primary antibody that binds to the BCL6 gene product. In some embodiments, the primary antibody is detectably labeled or is itself detectable by contacting the primary antibody with a detectably labeled secondary antibody that binds to the primary antibody. In some embodiments, the subject is a candidate for implantation of an embryo when an HSCORE calculated for the level of expression of the BCL6 gene product in the sample is less than a pre-determined cut-off value. In some embodiments, the HSCORE is calculated using the following equation: HSCORE=$\Sigma Pi\ (i+1)/100$, where i=the intensity of staining of cells in the sample with a value of 1 being low staining, 2 being moderate staining, and 3 being strong staining, and Pi being the percentage of stained cells in the sample for each intensity, varying from 0-100%. In some embodiments, the pre-determined cut-off value is selected from the group consisting of 1.0, 1.1, 1.2, 1.3, 1.4, 1.5, 1.6, 1.7, 1.8, 1.9, and 2.0.

The presently disclosed subject matter also provides in some embodiments methods for identifying subjects as candidates for implantation of embryos. In some embodiments, the methods comprise (a) providing a sample of endometrium from a subject, wherein the sample comprises endometrium isolated from the subject during the second half of the subject's menstrual cycle; (b) detecting a level of expression of a BCL6 gene product in the sample, an optionally a level of expression of a beta3 integrin gene product in the sample; (c) determining whether or not the endometrium of the subject is in phase or out of phase; (d) correlating the expression level or expression levels detected and whether or not the endometrium of the subject is histologically in phase or out of phase with receptivity of the endometrium of the subject; and (e) determining whether the subject is a candidate for implantation of an embryo based on the correlating step, wherein the determining step identifies the subject as a candidate for implantation of an embryo. In some embodiments, the sample is a biopsy sample, optionally a formalin fixed, paraffin embedded biopsy section thereof. In some embodiments, the detecting step comprises staining the sample with a first primary antibody that binds to the BCL6 gene product and a second primary antibody that binds to the beta3 integrin gene product. In some embodiments, the first primary antibody and the second primary antibody are applied to the sample at the same time, and in some embodiments the first primary antibody and the second primary antibody are applied to different aliquots of the sample (such as, but not limited to different serial sections of the sample). In some embodiments, the first and the second primary antibodies are detectably labeled or are themselves detectable by contacting the first primary antibody and the second primary antibody with a first detectably labeled secondary antibody that binds to the first primary antibody and a second detectably labeled secondary antibody that binds to the second primary antibody. In some embodiments, the subject is a candidate for implantation of an embryo if (i) an HSCORE calculated for the level of expression of the BCL6 gene product in the sample is less than a pre-determined cut-off value; or (ii) an HSCORE calculated for the level of expression of the beta3 integrin gene product in the sample is greater than a pre-determined cut-off value; or (iii) an HSCORE calculated for the level of expression of the beta3 integrin gene product in the sample is less than a pre-determined cut-off value and the endometrium of the subject is out of phase. In some embodiments, the HSCORE is calculated using the following equation: HSCORE=$\Sigma$Pi (i+1)/100, where i=the intensity of staining of cells in the sample with a value of 1 being low staining, 2 being moderate staining, and 3 being strong staining, and Pi being the percentage of stained cells in the sample for each intensity, varying from 0-100%. In some embodiments, the pre-determined cut-off value is selected from the group consisting of 1.0, 1.1, 1.2, 1.3, 1.4, 1.5, 1.6, 1.7, 1.8, 1.9, and 2.0.

The presently disclosed subject matter also provides in some embodiments, methods for identifying an increased risk for implantation failure subsequent to in vitro fertilization (IVF) and/or frozen embryo transfer (FET) in a subject. In some embodiments, the methods comprise determining a beta3 status, a BCL6 status, and an endometrial phase status for a subject undergoing IVF and/or FET treatment, wherein an abnormal BCL6 status in the subject and/or an abnormal beta3 status accompanied by in phase histological status is indicative of increased risk for implantation failure in the subject. In some embodiments, an abnormal BCL6 status comprises an HSCORE for the subject with respect to BCL6 gene product expression during the second half of the subject's menstrual cycle that is greater than a pre-determined cut-off value. In some embodiments, the HSCORE is calculated using the following equation: HSCORE=$\Sigma$Pi (i+1)/100, where i=the intensity of staining of cells in the sample with a value of 1 being low staining, 2 being moderate staining, and 3 being strong staining, and Pi being the percentage of stained cells in the sample for each intensity, varying from 0-100%. In some embodiments, the pre-determined cut-off value is selected from the group consisting of 1.0, 1.1, 1.2, 1.3, 1.4, 1.5, 1.6, 1.7, 1.8, 1.9, and 2.0. In some embodiments, an abnormal beta3 status comprises an HSCORE for the subject with respect to beta3 gene product expression during the second half of the subject's menstrual cycle that is greater than a pre-determined cut-off value.

The presently disclosed subject matter also provides in some embodiments methods for detecting endometrial receptivity to embryo implantation in subjects. In some embodiments, the methods comprise (a) obtaining a sample of endometrium from the subject, wherein the sample is isolated from the subject during the second half of the subject's menstrual cycle; (b) detecting an expression level of a BCL6 gene product in the sample; and (c) correlating the expression level of the BCL6 gene product in the sample with endometrial receptivity, wherein overexpression of the BCL6 gene product in the sample as compared to expression of the BCL6 gene product in a sample of endometrium isolated from a normally receptive control subject is indicative of reduced receptivity of the endometrium in the subject. In some embodiments, the subject is a subfertile subject. In some embodiments, the sample is a tissue section and the detecting step comprises immunohistochemically staining the sample with a primary antibody that binds to the BCL6 gene product and detecting binding of the primary antibody to the BCL6 gene product. In some embodiments, the primary antibody comprises a detectable label and detecting binding of the primary antibody to the BCL6 gene product comprises detecting the detectable label. In some embodiments, detecting binding of the primary antibody to the BCL6 gene product comprises detecting a complex of the primary antibody and the BCL6 gene product using a labeled secondary antibody that is specific for the primary antibody. In some embodiments, the sample is a cell extract and the contacting and detecting steps comprise (a) immunoblotting with a primary antibody comprising a detectable label that is specific for the BCL6 gene product and detecting the detectable label; or (b) immunoblotting with a primary antibody that is specific for the BCL6 gene product and detecting the primary antibody indirectly with a labeled secondary antibody that binds to the primary antibody. In some embodiments, the embryo is produced by in vitro fertilization (IVF) or the embryo implantation comprises frozen embryo transfer (FET).

In some embodiments, the presently disclosed subject matter also provides methods for facilitating a diagnosis of infertility in a mammal. In some embodiments, the methods comprise (a) obtaining a sample of endometrium from the mammal, wherein the sample is isolated from the mammal during the second half of the mammal's menstrual cycle; (b) detecting expression of BCL6 in the sample; and (c) correlating overexpression of BCL6 in the sample with infertility. In some embodiments, the sample is a tissue section and the detecting step comprises immunohistochemically staining the sample with a primary antibody that binds to a BCL6 gene product and detecting binding of the primary antibody to the BCL6 gene product. In some embodiments, the primary antibody comprises a detectable label and detecting binding of the primary antibody to the BCL6 gene product comprises detecting the detectable label. In some embodiments, detecting binding of the primary antibody to the BCL6 gene product comprises detecting a complex of the primary antibody and the BCL6 gene product using a labeled secondary antibody that is specific for the primary antibody. In some embodiments, the sample is a cell extract and the contacting and detecting steps comprise (a) immunoblotting with a primary antibody comprising a detectable label that is specific for the BCL6 gene product and detecting the detectable label; or (b) immunoblotting with a primary antibody that is specific for the BCL6 gene product and detecting the primary antibody indirectly with a labeled secondary antibody that binds to the primary antibody.

The presently disclosed subject matter also provides methods for increasing the likelihood of implantation of embryos in subjects with decreased endometrial receptivity due to overexpression of a BCL6 gene product during the second half of the subjects' menstrual cycles. In some embodiments, the methods comprise (a) providing a subject with decreased endometrial receptivity due to increased BCL6 expression; and (b) administering to the subject an effective amount of a BCL6 inhibitor.

In some embodiments, the presently disclosed subject matter also provides methods for detecting the presence of endometriosis in subjects. In some embodiments, the methods comprise (a) providing a sample of endometrium from a subject, wherein the sample comprises endometrium isolated from the subject during the second half of the subject's menstrual cycle; (b) detecting a level of expression of a BCL6 gene product in the sample; and (c) correlating the expression level of the BCL6 gene product in the sample with the presence of endometriosis in the subject, wherein overexpression of the BCL6 gene product in the sample as compared to expression of the BCL6 gene product in a sample of similarly timed endometrium isolated from a normal control subject is indicative of the presence of endometriosis in the subject. In some embodiments, the sample is a biopsy sample, optionally a formalin fixed, paraffin embedded biopsy section thereof. In some embodiments, the detecting step comprises staining the sample with a primary antibody that binds to the BCL6 gene product. In some embodiments, the primary antibody is detectably labeled or is itself detectable by contacting the primary antibody with a detectably labeled secondary antibody that binds to the primary antibody. In some embodiments, the presence of endometriosis in the subject is indicated when an HSCORE calculated for the level of expression of the BCL6 gene product in the sample is less than a pre-determined cut-off value. In some embodiments, the HSCORE is calculated using the following equation: HSCORE=$\Sigma Pi$ (i+1)/100, where i=the intensity of staining of cells in the sample with a value of 1 being low staining, 2 being moderate staining, and 3 being strong staining, and Pi being the percentage of stained cells in the sample for each intensity, varying from 0-100%. In some embodiments, the pre-determined cut-off value is selected from the group consisting of 1.0, 1.1, 1.2, 1.3, 1.4, 1.5, 1.6, 1.7, 1.8, 1.9, and 2.0.

In some embodiments, the presently disclosed subject matter also provides methods for managing treatment of subjects with potential endometriosis, subfertility, or both endometriosis and subfertility. In some embodiments, the methods comprise (a) providing a subject suspected of having endometriosis, subfertility, or both endometriosis and subfertility; (b) detecting the presence or absence of biomarkers BCL6, beta3, or both BCL6 and beta3 in a sample from the subject; and (c) managing the treatment of the subject based on the detecting in step (b). In some embodiments, the presence of BCL6 suggests the presence of endometriosis. In some embodiments, the managing of the treatment of subject comprises assigning the subject for surgery to treat the endometriosis. In some embodiments, the presence of BCL6 and the absence of beta3 suggests the presence of endometriosis-related subfertility due to endometrial dysfunction. In some embodiments, the managing of the treatment of the subject comprises assigning the subject for surgery to treat the subfertility. In some embodiments, the managing of the treatment of the subject comprises assigning the subject for a treatment other than surgery to treat subfertility. In some embodiments, the presence of BCL6 and absence of beta3 suggests subfertility due to endometrial dysfunction. In some embodiments, the managing of the treatment of the subject comprises assessing histomorphology of the sample for midsecretory phase and assigning the subject for a treatment other than surgery to treat endometriosis-related subfertility. In some embodiments, the absence of BCL6 and absence of beta3 is observed and the managing of the treatment of the subject comprises assessing histomorphology of the sample for early secretory phase or proliferative phase.

In some embodiments, the presently disclosed subject matter provides methods for detecting the presence of endometriosis, subfertility, or both endometriosis and subfertility in subjects. In some embodiments, the methods comprise (a) providing a subject suspected of having endometriosis, subfertility, or both endometriosis and subfertility; (b) detecting the presence or absence of biomarker BCL6, optionally biomarkers BCL6 and beta3, in a sample from the subject; and (c) determining the presence of endometriosis, subfertility, or both endometriosis and subfertility in the subject based on the detecting in step (b). In some embodiments, the sample comprises a uterine tissue sample. In some embodiments, the sample comprises fluids and/or washings of the uterine lining, a cervical lavage, a brushing, and/or blood.

In some embodiments of any of the disclosed methods, the subject is a human subject.

Thus, in accordance with the presently disclosed subject matter, provided herein in some embodiments is a method for managing treatment of a subject with potential endometriosis, subfertility or both endometriosis and subfertility in a subject. In some embodiments, the method comprises providing a subject suspected of having endometriosis, subfertility, or both endometriosis and subfertility; detecting the presence or absence of biomarkers BCL6, beta3, or both BCL6 and beta3 in a sample from the subject; and managing the treatment of the subject based on the results of the detecting step.

In some embodiments, the presence of BCL6 suggests the presence of endometriosis. In some embodiments, the managing of the treatment of subject comprises assigning the subject for surgery to treat the endometriosis. In some embodiments, the presence of BCL6 combined with the absence of beta3 suggests the presence of and/or an enhanced risk for endometriosis-related subfertility due to endometrial dysfunction. In some embodiments, the managing of the treatment of the subject comprises assigning the subject for surgery to treat the subfertility.

In some embodiments, the managing of the treatment of the subject comprises assigning the subject for a treatment other than surgery to treat subfertility. In some embodiments, the managing of the treatment of the subject comprises assessing histomorphology of the sample for midsecretory phase and assigning the subject for a treatment other than surgery to treat endometriosis-related subfertility. In some embodiments, the absence of BCL6 and the absence of beta3 is observed and the managing of the treatment of the subject comprises assessing histomorphology of the sample (in some embodiments an endometrial biopsy) for early secretory phase or proliferative phase.

In some embodiments, a method for detecting the presence of endometriosis, subfertility, or both endometriosis and subfertility in a subject is provided. In some embodiments, the method comprises providing a subject suspected of having endometriosis, subfertility, or both endometriosis and subfertility; detecting the presence or absence of biomarkers BCL6, beta3, or both BCL6 and beta3 in a sample from the subject; and determining the presence of endometriosis, subfertility, or both endometriosis and subfertility in the subject based on the detecting step.

In some embodiments, the sample comprises a uterine tissue sample. In some embodiments, the subject is a human subject. In some embodiments, the sample comprises fluids and/or washings of the uterine lining, a cervical lavage, a brushing, and/or blood.

In some embodiments, the presently disclosed subject matter provides methods for treating subjects with endometriosis associated with overexpression of endometrial BCL6 during the secretory phase of the menstrual cycle. In some embodiments, the methods comprise (a) providing a subject with endometriosis associated with overexpression of endometrial BCL6 during the secretory phase of the menstrual cycle; (b) administering to the subject a treatment that reduces or eliminates the subject's endometriosis; and (c) assaying endometrial BCL6 gene expression during the secretory phase of the menstrual cycle of the subject to determine if endometrial BCL6 gene expression in the subject has been reduced to below a pre-determined level, wherein steps (b) and (c) are optionally repeated until endometrial BCL6 gene expression is reduced to below a pre-determined level during the secretory phase of the subject's menstrual cycle. In some embodiments, the treatment that reduces or eliminates the subject's endometriosis comprises surgical removal of some or all of the endometriosis, treatment of the subject with a gonadotropin-releasing hormone (GnRH) agonist, or both. In some embodiments, the assaying comprises contacting an endometrial biopsy sample isolated from the subject during the secretory phase of the subject's menstrual cycle with an antibody that binds to BCL6 to create a BCL6/antibody complex, and detecting the amount of the complex formed.

For any of the presently disclosed methods, the assays of any biomarker can be repeated whenever an assessment of the expression of the biomarker might be desirable, including but not limited to multiple assessments to monitor treatment or to determine if any changes in biomarker expression, receptivity, the presence or absence of endometriosis, etc.

Any and all methods, devices, systems, apparatuses, kits, compositions, and/or uses shown and/or described expressly or by implication in the present disclosure, including but not limited to features that may be apparent and/or understood by those of skill in the art, also constitute a part of the presently disclosed subject matter.

Accordingly, it is an object of the presently disclosed subject matter to provide methods for detecting endometriosis and/or subfertility, and/or for assessing the likelihood of successful implantation of in vitro fertilized ova and/or frozen embryos. This and other objects are achieved in whole or in part by the presently disclosed subject matter.

An object of the presently disclosed subject matter having been stated above, other objects and advantages will become apparent upon a review of the following description and Figures.

BRIEF DESCRIPTION OF THE FIGURES

FIG. 1A depicts beta3 expression in normal tissue, and FIG. 1B depicts BCL6 expression in normal tissue. In the case of endometriosis or subfertility due to other causes (including but not limited to hydrosalpinges and/or adenomyosis), beta3 was sometimes absent as in FIG. 1C, while BCL6 was usually present at abnormally high levels as in FIG. 1D.

FIG. 3A shows relative BCL6 mRNA expression levels in whole endometrium (p=0.0005). FIG. 3B shows relative BCL6 mRNA expression levels in endometrial epithelium (p=0.02). FIG. 3C shows relative BCL6 mRNA expression levels in endometrial stroma (p>0.05). For each of FIGS. 3A-3C, boxes represent median and interquartile ranges. Whiskers include values within 1.5 times the interquartile range beyond the 25th and 75th percentile. Outliers are represented by individual points (●). p values compare data derived from the secretory phase time points relative to those of proliferative phase time points. P: proliferative phase; ES: early secretory phase; MS: mid-secretory phase; LS: late secretory phase.

FIG. 6A shows that with only a small subset of subjects were negative for beta3 with normal histomorphology (Type II; 10%). With respect to BCL6 expression however, 83% of subjects tested positive (see FIG. 6B). Subjects with absent beta3 (Type I) and subjects with normal beta3 expression both were associated with a 20% pregnancy rate and were not discriminatory for IVF success. The presence of Type II beta3 defects was 100% discriminatory, as none of the subjects with Type II defects conceived (see FIG. 6C). For BCL6, the positive subjects rarely conceived (10.2%; see FIG. 6D) while 60% of BCL6 negative (i.e., Normal) subjects conceived with IVF or FET cycles (see FIG. 6D).

BRIEF DESCRIPTION OF THE SEQUENCE LISTING

Figure 1:
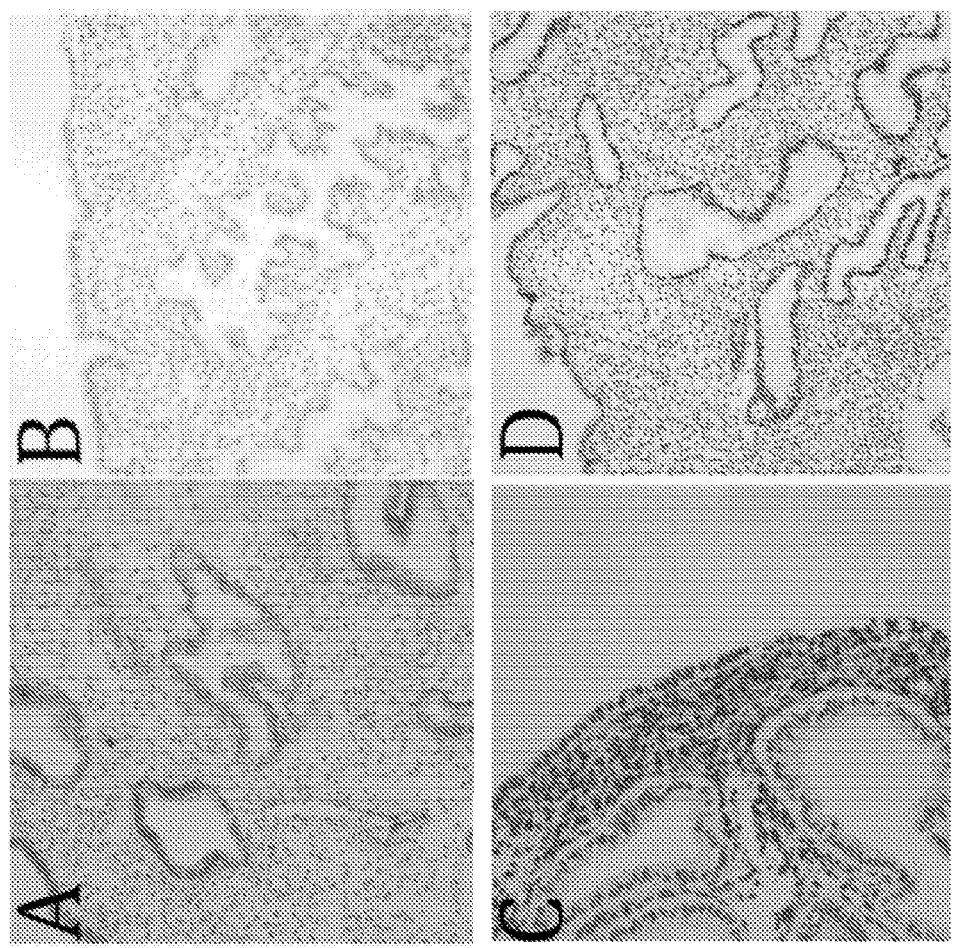
FIGS. 1A-1D depict the results of immunohistochemical analyses of beta3 and BCL6 in normal and endometriosis tissue.

SEQ ID NOs: 1-72 are exemplary nucleotide and amino acid sequences of BCL6 gene products from various species.
SEQ ID NOs: 73-116 are exemplary nucleotide and amino acid sequences of beta3 gene products from various species.

DETAILED DESCRIPTION

The present subject matter will be now be described more fully hereinafter with reference to the accompanying EXAMPLES, in which representative embodiments of the presently disclosed subject matter are shown. The presently disclosed subject matter can, however, be embodied in different forms and should not be construed as limited to the embodiments set forth herein. Rather, these embodiments are provided so that this disclosure will be thorough and complete, and will fully convey the scope of the presently disclosed subject matter to those skilled in the art.

While the following terms are believed to be well understood by one of ordinary skill in the art, the following definitions are set forth to facilitate explanation of the presently disclosed subject matter.

Following long-standing patent law convention, the terms "a" and "an" mean "one or more" when used in this application, including the claims.

Unless otherwise indicated, all numbers expressing quantities of size, biomarker concentration, probability, percentage, and so forth used in the specification and claims are to be understood as being modified in all instances by the term "about". For example, the amounts can vary by about 10%, 5%, 1%, or 0.5%. Accordingly, unless indicated to the contrary, the numerical parameters set forth in this specification and attached claims are approximations that can vary depending upon the desired properties sought to be obtained by the presently disclosed subject matter.

The term "and/or" when used in describing two or more items or conditions refers to situations where all named items or conditions are present or applicable, or to situations wherein only one (or less than all) of the items or conditions is present or applicable.

As used herein, the term "BCL6" refers to the B-cell lymphoma 6 gene (also referred to as the B-cell CLL/lymphoma 6 gene; gene symbol BCL6) as well as gene products encoded and/or derived therefrom. In humans, the BCL6 gene is present on chromosome 3. Exemplary human BCL6 gene products include, but are not limited to the nucleotide sequences disclosed in the GENBANK® biosequence database at Accession Nos. NM_001706 (transcript variant 1; SEQ ID NO: 1), NM_001130845 (transcript variant 2; SEQ ID NO: 3), and NM_001134738 (transcript variant 3; (SEQ ID NO: 5), which encode the amino acid sequences disclosed in GENBANK® biosequence database Accession Nos. NP_001697 (SEQ ID NO: 2), NP_001124317 (SEQ ID NO: 4), and NP_001128210 (SEQ ID NO: 6), respectively. The term "BCL6" also corresponds to orthologs of human BCL6 from other species, including but not limited to those set forth herein below in Table 1.

TABLE 1

Exemplary Non-human BCL6 Orthologous Sequences

| Species | Nucleotide[1] | Amino Acid[1] |
| --- | --- | --- |
| Pan paniscus | XM_003824955 (SEQ ID NO: 7) | XP_003825003 (SEQ ID NO: 8) |
| | XM_008978648 (SEQ ID NO: 9) | XP_008976896 (SEQ ID NO: 10) |
| | XM_008978646 (SEQ ID NO: 11) | XP_008976894 (SEQ ID NO: 12) |
| Pan troglodytes | XM_001158812 (SEQ ID NO: 13) | XP_001158812 (SEQ ID NO: 14) |
| | XM_009446993 (SEQ ID NO: 15) | XP_009445268 (SEQ ID NO: 16) |
| | XM_009446989 (SEQ ID NO: 17) | XP_009445264 (SEQ ID NO: 18) |

TABLE 1-continued

Exemplary Non-human BCL6 Orthologous Sequences

| Species | Nucleotide[1] | Amino Acid[1] |
|---|---|---|
| Chlorocebus sabaeus | XM_008009503 (SEQ ID NO: 19) | XP_008007694 (SEQ ID NO: 20) |
| | XM_008009504 (SEQ ID NO: 21) | XP_008007695 (SEQ ID NO: 22) |
| | XM_008009507 (SEQ ID NO: 23) | XP_008007698 (SEQ ID NO: 24) |
| Saimiri boliviensis boliviensis | XM_003927003 (SEQ ID NO: 25) | XP_003927052 (SEQ ID NO: 26) |
| | XM_010337713 (SEQ ID NO: 27) | XP_010336015 (SEQ ID NO: 28) |
| | XM_010337712 (SEQ ID NO: 29) | XP_010336014 (SEQ ID NO: 30) |
| Pongo abelii | NM_001159790 (SEQ ID NO: 31) | NP_001153262 (SEQ ID NO: 32) |
| Gorilla gorilla gorilla | XM_004038190 (SEQ ID NO: 33) | XP_004038238 (SEQ ID NO: 34) |
| Orcinus orca | XM_004278481 (SEQ ID NO: 35) | XP_004278529 (SEQ ID NO: 36) |
| | XM_004278482 (SEQ ID NO: 37) | XP_004278530 (SEQ ID NO: 38) |
| Canis lupus familiaris | XM_005639719 (SEQ ID NO: 39) | XP_005639776 (SEQ ID NO: 40) |
| | XM_005639720 (SEQ ID NO: 41) | XP_005639777 (SEQ ID NO: 42) |
| | XM_005639722 (SEQ ID NO: 43) | XP_005639779 (SEQ ID NO: 44) |
| Equus caballus | XM_001499782 (SEQ ID NO: 45) | XP_001499832 (SEQ ID NO: 46) |
| | XM_005601882 (SEQ ID NO: 47) | XP_005601939 (SEQ ID NO: 48) |
| | XM_003363354 (SEQ ID NO: 49) | XP_003363402 (SEQ ID NO: 50) |
| Felis catus | XM_006936189 (SEQ ID NO: 51) | XP_006936251 (SEQ ID NO: 52) |
| | XM_003991804 (SEQ ID NO: 53) | XP_003991853 (SEQ ID NO: 54) |
| | XM_006936190 (SEQ ID NO: 55) | XP_006936252 (SEQ ID NO: 56) |
| Bos taurus | NM_001206450 (SEQ ID NO: 57) | NP_001193379 (SEQ ID NO: 58) |
| | XM_005201513 (SEQ ID NO: 59) | XP_005201570 (SEQ ID NO: 60) |
| Rattus norvegicus | NM_001107084 (SEQ ID NO: 61) | NP_001100554 (SEQ ID NO: 62) |
| | XM_008768799 (SEQ ID NO: 63) | XP_008767021 (SEQ ID NO: 64) |
| | BC166425 (SEQ ID NO: 65) | AAI66425 (SEQ ID NO: 66) |
| Mus musculus | NM_009744 (SEQ ID NO: 67) | NP_033874 (SEQ ID NO: 68) |
| | AK039228 (SEQ ID NO: 69) | BAC30286 (SEQ ID NO: 70) |
| | AK036975 (SEQ ID NO: 71) | BAC29654 (SEQ ID NO: 72) |

[1]Listed are exemplary GENBANK ® biosequence database Accession Nos.

As used herein, the term "beta3" refers to the beta 3 integrin gene (also referred to as the platelet glycoprotein Ma gene and the antigen CD61 gene; gene symbol ITGB3) as well as gene products encoded and/or derived therefrom. In humans, the beta3 gene is present on chromosome 17. Exemplary human beta3 gene products include, but are not limited to the nucleotide sequences disclosed in the GENBANK® biosequence database at Accession Nos. NM_000212 (SEQ ID NO: 73) and M35999 (SEQ ID NO: 75), which encode the amino acid sequences disclosed in GENBANK® biosequence database Accession Nos. NP_000203 (SEQ ID NO: 74) and AAA35927 (SEQ ID NO: 76), respectively. The term "beta3" also corresponds to orthologs of human beta3 from other species, including but not limited to those set forth herein below in Table 2.

TABLE 2

Exemplary Non-human ITGB3 Orthologous Sequences

| Species | Nucleotide[1] | Amino Acid[1] |
|---|---|---|
| Gorilla gorilla gorilla | XM_004041453 (SEQ ID NO: 77) | XP_004041501 (SEQ ID NO: 78) |
| Chlorocebus sabaeus | XM_008012292 (SEQ ID NO: 79) | XP_008010483 (SEQ ID NO: 80) |
| | XM_008012293 (SEQ ID NO: 81) | XP_008010484 (SEQ ID NO: 82) |
| Macaca mulatta | XM_005584610 (SEQ ID NO: 83) | XP_005584667 (SEQ ID NO: 84) |
| | XM_001116013 (SEQ ID NO: 85) | XP_001116013 (SEQ ID NO: 86) |
| Pan troglodytes | XM_523684 (SEQ ID NO: 87) | XP_523684 (SEQ ID NO: 88) |
| Pan paniscus | XM_008961749 (SEQ ID NO: 89) | XP_008959997 (SEQ ID NO: 90) |
| Pongo abelii | XM_002834317 (SEQ ID NO: 91) | XP_002834363 (SEQ ID NO: 92) |
| | XM_009236637 (SEQ ID NO: 93) | XP_009234912 (SEQ ID NO: 94) |
| Orcinus orca | XM_004275670 (SEQ ID NO: 95) | XP_004275718 (SEQ ID NO: 96) |
| | XM_004275671 (SEQ ID NO: 97) | XP_004275719 (SEQ ID NO: 98) |
| Canis lupus familiaris | NM_001003162 (SEQ ID NO: 99) | NP_001003162 (SEQ ID NO: 100) |
| | XM_005624174 (SEQ ID NO: 101) | XP_005624231 (SEQ ID NO: 102) |
| Equus caballus | NM_001081802 (SEQ ID NO: 103) | NP_001075271 (SEQ ID NO: 104) |
| Felis catus | XM_003997035 (SEQ ID NO: 105) | XP_003997084 (SEQ ID NO: 106) |
| Bos taurus | NM_001206490 (SEQ ID NO: 107) | NP_001193419 (SEQ ID NO: 108) |
| Sus scrofa | NM_214002 (SEQ ID NO: 109) | NP_999167 (SEQ ID NO: 110) |
| | AF170527 (SEQ ID NO: 111) | AAD51953 (SEQ ID NO: 112) |
| Saimiri boliviensis boliviensis | XM_010330277 (SEQ ID NO: 113) | XP_010328579 (SEQ ID NO: 114) |
| | XM_010330278 (SEQ ID NO: 115) | XP_010328580 (SEQ ID NO: 116) |

[1]Listed are exemplary GENBANK ® biosequence database Accession Nos.

As used herein, the term "comprising", which is synonymous with "including", "containing", and "characterized by", is inclusive or open-ended and does not exclude additional, unrecited elements and/or method steps. "Comprising" is a term of art that means that the named elements and/or steps are present, but that other elements and/or steps can be added and still fall within the scope of the relevant subject matter.

As used herein, the phrase "consisting of" excludes any element, step, or ingredient not specified in the claim. When the phrase "consists of" appears in a clause of the body of a claim, rather than immediately following the preamble, it limits only the element set forth in that clause; other elements are not excluded from the claim as a whole.

As used herein, the phrase "consisting essentially of" limits the scope of a claim to the specified materials or steps, plus those that do not materially affect the basic and novel characteristic(s) of the claimed subject matter.

With respect to the terms "comprising", "consisting essentially of", and "consisting of", where one of these three terms is used herein, the presently disclosed subject matter can include the use of either of the other two terms. For example, the presently disclosed subject matter relates in some embodiments to for detecting the presence of endometriosis, subfertility, or both endometriosis and subfertility in a subject, which methods comprise detecting the presence or absence of biomarkers BCL6, beta3, or both BCL6 and beta3 in a sample from the subject. It is understood that the presently disclosed subject matter thus also encompasses methods that in some embodiments consist essentially of detecting the presence or absence of biomarkers BCL6, beta3, or both BCL6 and beta3 in a sample from the subject; as well as methods that in some embodiments consist of detecting the presence or absence of biomarkers BCL6, beta3, or both BCL6 and beta3 in a sample from the subject.

"Amino acid sequence" and terms such as "peptide", "polypeptide", and "protein" are used interchangeably herein, and are not meant to limit the amino acid sequence to the complete, native amino acid sequence (i.e. a sequence containing only those amino acids found in the protein as it occurs in nature) associated with the recited protein molecule. The proteins and protein fragments of the presently disclosed subject matter can be produced by recombinant approaches or can be isolated from a naturally occurring source. The protein fragments can be any size, and for example can range in size from four amino acid residues to the entire amino acid sequence minus one amino acid.

The terms "antibody" and "immunoglobulin" include antibodies or immunoglobulins of any isotype, fragments of antibodies that retain specific binding to antigen, including but not limited to Fab, Fv, scFv, and Fd fragments, chimeric antibodies, humanized antibodies, single-chain antibodies, and fusion proteins including an antigen-binding portion of an antibody and a non-antibody protein. The antibodies can in some embodiments be detectably labeled, e.g., with a radioisotope, an enzyme which generates a detectable product, a fluorescent protein, and the like. The antibodies can in some embodiments be further conjugated to other moieties, such as members of specific binding pairs, e.g., biotin (member of biotin-avidin specific binding pair), and the like. Also encompassed by the terms are Fab', Fv, F(ab')$_2$, and other antibody fragments that retain specific binding to antigen (e.g., any antibody fragment that comprises at least one paratope).

Antibodies can exist in a variety of other forms including, for example, Fv, Fab, and (Fab')$_2$, as well as bi-functional (i.e., bi-specific) hybrid antibodies (see e.g., Lanzavecchia et al., 1987) and in single chains (see e.g., Huston et al., 1988 and Bird et al., 1988, each of which is incorporated herein by reference in its entirety). See generally, Hood et al., 1984, and Hunkapiller & Hood, 1986. The phrase "detection molecule" is used herein in its broadest sense to include any molecule that can bind with sufficient specificity to a biomarker to allow for detection of the particular biomarker. To allow for detection can mean to determine the presence or absence of the particular biomarker member and, in some embodiments, can mean to determine the amount of the particular biomarker. Detection molecules can include antibodies, antibody fragments, and nucleic acid sequences.

The phrase "detection molecule" is used herein in its broadest sense to include any molecule that can bind with sufficient specificity to a biomarker to allow for detection of the particular biomarker. To allow for detection can mean to determine the presence or absence of the particular biomarker member and, in some embodiments, can mean to determine the amount of the particular biomarker. Detection molecules can include, but are not limited to antibodies, antibody fragments, and nucleic acid sequences.

As used herein, the term "sample" is used in its broadest sense. In one sense, it is meant to include a specimen from a biological source. Biological samples can be obtained from animals (including humans) and encompass fluids (e.g., blood, mucus, urine, saliva), solids, tissues, cells, and gases. The sample can comprise fluids or washings of the uterine lining or sample prepared by similar techniques involving cervical lavage or brushings. The presence of BCL6 in blood may also provide a surrogate marker for the presence of this marker in the endometrium or its associated tissues.

The phrase "a specific binding partner for each of the detection molecules" is used herein to include any molecule that binds with sufficient specificity to one of the detection molecules to allow for detection of the particular detection molecule. For example, in some embodiments the specific binding partner can be a secondary antibody that recognizes the detection molecule that is a primary antibody. In some embodiments the specific binding partner can be a molecule that specifically binds to a group on the detection molecule such as, for example, a biotin group on the detection molecule.

As used herein, the term "subject" refers to any animal, including but not limited to any mammal, such as but not limited to humans, non-human primates, rodents, and the like, which is to be the recipient of a particular treatment. The terms "subject" and "patient" are in some embodiments used interchangeably herein, such as but not limited to in reference to a human subject or patient.

As used herein, the term "subfertility", and grammatical variations thereof, refers to the condition of being less than normally fertile, which can be further characterized as a prolonged period of non-conception. In some cases, a subfertile subject can still capable of effecting conception. However, in other cases, the term "subfertility" is also meant to encompass an infertile subject. The term "subfertility" can also pertain to a condition whereby a person can conceive but not successfully complete the pregnancy, as in miscarriage or recurrent abortion. The term "subfertility" is also meant to encompass difficulties with regard to embryo implantation, including but not limited to embryo implantation related to in vitro fertilization (IVF) treatment and/or with respect to frozen embryo transfer (FET).

The endometrium is a dynamic, hormone responsive tissue that undergoes repetitive proliferation, differentiation, apoptosis, tissue breakdown, and repair to support its major function of regulating embryo implantation. These dynamic changes are orchestrated, directly and indirectly, by the sex steroids estrogen and progesterone, and mediated by paracrine factors, including classical immune system cytokines and chemokines (Large & Demayo, 2012). Sex steroids, cytokines, and chemokines also regulate cyclic changes in the numbers, proportions, and phenotypes of endometrial leukocytes, which can make up as much as 40% of the cellular mass of the human endometrium.

Inflammation and altered endometrial gene expression leading to infertility is now a recognized syndrome of progesterone resistance (Aghajanova et al., 2010; Lessey et al., 2013). Endometriosis is an inflammatory condition and a leading cause of infertility, affecting an estimated 176 million women worldwide (Adamson et al., 2010; Guidice, 2010; Holoch & Lessey, 2010). While decreased fertility due to problems with ovum pickup and transport is an established mechanism in women with more severe endometriosis, the basis for widespread infertility in milder forms of endometriosis remains poorly understood. Evidence to date suggests that abnormal endometrial function, associated with altered cellular immunity and resistance to progesterone signaling could be a major factor contributing to reduced receptivity to embryo implantation (Lessey & Young, 2014).

Integrins are a family of cell surface receptors for extracellular matrix (ECM) proteins and are believed to play key roles in the adhesion and motility of cells. Implantation involves complex alterations in the integrin expression in both the endometrium and the trophoblast, which are likely involved in attachment and invasion at the maternal-fetal interface. The instant co-inventors initially demonstrated that specific integrin expression patterns were present only during the putative window of implantation and that the loss of key integrins such as the αvβ3 vitronectin receptor in the glandular and luminal endometrial epithelium was associated with certain types of infertility (see Lessey et al., 1992). Those preliminary studies suggested that β3 integrin could be employed as a marker of uterine receptivity. Delayed or aberrant expression has been observed in the endometrium of infertile women with luteal phase defect (Lessey et al., 1992), endometriosis (Lessey et al., 1994a), tubal disease with hydrosalpinges (Meyer et al., 1997), and unexplained infertility (Lessey et al., 1995). Therapy that results in improvement in pregnancy rates has been shown to restore normal β3 integrin subunit expression (Meyer et al., 1997).

Over the ensuing years, β3 integrin subunit testing for endometrial receptivity (E-TEGRITY® brand (β3 integrin subunit test; Innovative Reproductive Solutions, Boston, Mass., United States of America) has detected women with defects in endometrial receptivity due to endometriosis and other inflammatory conditions such as hydrosalpinges. The E-TEGRITY® brand β3 integrin subunit test is widely used, with approximately 100 tests performed per month around the world. This test, however, has several key shortcomings. Since normal endometrial β3 integrin subunit expression only occurs after cycle day 20, all samples with histological delay lack this biomarker regardless of receptivity status (Creus et al., 2002). This leads to a blind spot in the testing when histology lags behind the time of the biopsy. While a positive test (missing beta3 integrin subunit when the histopathology is normal) has an excellent predictive value for implantation failure, it has now become apparent that many women with infertility and endometriosis still express the β3 integrin subunit normally, even when endometrial receptivity defects exist. Thus the test lacks sensitivity despite its high specificity.

Global gene profiling has identified the B-cell chronic lymphocytic leukemia (CLL)/lymphoma 6 (BCL6) gene product as a regulated secretory protein in human endometrium (Talbi et al., 2006; Burney et al., 2009). BCL6 is a proto-oncogene and transcriptional repressor that contributes to cell cycle control and differentiation and apoptosis inhibition (Kumagai et al., 1999; Kojima et al., 2001). Its expression is typically associated with increased proliferation (Shaffer et al., 2000), and it is overexpressed in many cancers. Mechanistic studies have demonstrated that BCL6 can also regulate cytokine expression, including interleukin (IL)-1, IL-6, IL-18, and colony stimulating factor-1 (CSF-1), all of which have been implicated in regulation of embryo implantation (Takeda et al., 2003; Yu et al., 2005; Chaouat et al., 2007). Further, recent evidence has linked BCL6 to interference in the sonic hedgehog pathway, specifically through down-regulation of Gli-1 (Tiberi et al., 2014), a pathway in common with progesterone signaling and the Indian Hedgehog pathway in endometrium (Wei et al., 2010). As such, the instant disclosure provides that BCL6 is a suspected mediator of progesterone resistance and therefore a primary cause of infertility due to inflammatory conditions such as but not limited to endometriosis and hydrosalpinges.

BCL6 is a zinc finger transcription factor that acts as a sequence-specific repressor of transcription, which in T-cells promotes formation of memory B-cells. Endometriosis is a common, sometimes debilitating disorder that is a frequent cause of pain and infertility. The disease, found in greater than 5% of all reproductive age women, is characterized by lesions in the peritoneal cavity that closely resemble the endometrium found inside the uterine cavity. Currently, there is no reliable diagnostic test for endometriosis except surgical exploration. This is undesirable for several reasons, not least because one does not want to perform exploratory surgery on someone without disease that itself can be addressed surgically, which now occurs frequently. In addition, endometriosis contributes to the majority of unexplained infertility, which when not discovered, can lead to expensive and often unsuccessful therapies. An accurate test for endometriosis could also provide new opportunities for non-surgical (i.e., medical) management. A diagnostic test that also comprises the root cause of the infertility might also provide new opportunities for novel therapies directed at progesterone resistance.

In accordance with the presently disclosed subject matter, BCL6 gene expression has been observed to be markedly elevated in the uterine endometrium of women with endometriosis in both the proliferative and secretory phases relative to women its expression in the uterine endometrium of women who do not have endometriosis. In women with endometriosis, BCL6 gene (over)expression is also very clearly evident at the protein level as assessed by immunohistochemistry in the secretory phase, whereas staining is virtually absent in normal patients (i.e., women without endometriosis). Accordingly, in some embodiments, endometrial tissue can be assessed for BCL6 mRNA and/or protein expression as a diagnostic test for the presence or absence of endometriosis, especially in the secretory phase, where endometrial biopsy is preferred at least in part because during the proliferative phase the subject has not yet ovulated and cannot, therefore, be in very early pregnancy when a biopsy might disturb an implanting embryo.

In some embodiments, the presently disclosed subject matter utilizes a first biomarker (i.e., BCL6) that is highly sensitive to the presence of endometriosis, and in some embodiments utilizes a second biomarker (i.e., the beta3 integrin subunit) that is specific for uterine causes of infertility, which in some embodiments can be combined with traditional histo-morphological feature assessment. These tests can be performed, for example, on formalin fixed, paraffin embedded tissue sections using hematoxylin and eosin staining (H&E staining or HE staining) in combination with immunostaining for BCL6 and optionally also beta3.

BCL6 expression was then examined in subjects at various stages of the menstrual cycle. Normal endometrium and endometrium from women with endometriosis were examined, and it was discovered that BCL6 was dramatically (for example, 5-10 fold) elevated in eutopic endometrium of women with endometriosis. It was at first studied in the proliferative phase since no expression of BCL6 is normally present during this early phase of the menstrual cycle. In the secretory phase, some expression is present normally. Immunostaining of many samples was performed in both phases in normal women and women with endometriosis. It is felt that both phases are acceptable times to use BCL6 as a marker for endometriosis.

Since beta3 integrin assessment is typically performed in the mid-secretory phase, it was determined that the BCL6 test disclosed herein provided additional information over beta3 integrin testing alone. Particularly, it was observed that a negative test (i.e., a positive beta3 result, meaning that beta3 is being expressed at a normal level) is often misleading and can become non-informative for the diagnosis of endometriosis or other causes of endometrial receptivity defects under certain conditions. Overexpression of BCL6 (for example, an expression level that is above a defined HSCORE cut-off) in the presence or the absence of beta3 expression was an indication that endometriosis was present at any stage of disease. The lack of beta3 expression in in phase histologically normal endometrium could have additional meaning for implantation failure, as with IVF and/or FET.

Thus, the presence of BCL6 is exquisitely sensitive to the presence of endometriosis even in its mildest forms. In some embodiments, the presently disclosed biomarker tests are employed on endometrial biopsy samples. In some embodiments, the presently disclosed biomarker tests are employed in less invasive techniques such as endometrial or cervical lavage, endometrial brushings, and/or even a blood test.

In accordance with some embodiments of the presently disclosed subject matter, methods for identifying a subject as a candidate for implantation of an embryo are provided. As used herein, the phrase "candidate for implantation of an embryo" refers in some embodiments to a subfertile subject (who in some embodiments can be an infertile subject) who is attempting to get pregnant or be impregnated via an assisted reproductive technology (ART) that involves transferring an embryo into the uterus of the subject. In some embodiments, the embryo was produced by in vitro fertilization, and in some embodiments the embryo was a frozen embryo that is being transferred into the subject via frozen embryo transfer. As disclosed herein, candidates for implantation of an embryo are those subjects who, by employing the methods and compositions disclosed herein, are likely to have receptive endometrium.

Subjects that are likely to have receptive endometrium include those who do not have endometriosis. As set forth herein, the presence of endometriosis correlates strongly with BCL6 overexpression during the second half of the menstrual cycle, and thus in some embodiments the presently disclosed methods comprise determining whether or not a particular subject has endometriosis by determining whether or not the subject overexpresses BCL6 during the second half of her menstrual cycle.

In some embodiments of the presently disclosed methods, identifying a subject as a candidate for implantation of an embryo comprises providing a sample of endometrium from a subject, wherein the sample comprises endometrium isolated from the subject during the second half of the subject's menstrual cycle; and detecting a level of expression of a BCL6 gene product in the sample, wherein overexpression of the BCL6 gene product in the sample as compared to expression of the BCL6 gene product in a sample of similarly timed endometrium isolated from a normally fertile control subject is indicative of reduced receptivity of the endometrium in the subject. A subject who does not overexpress BCL6 at the relevant time are thus likely to have receptive endometrium, and is thus identified as a candidate for implantation of an embryo.

More particularly, in some embodiments a method for identifying a subject as a candidate for implantation of an embryo comprises providing a sample of endometrium from a subject, wherein the sample comprises endometrium isolated from the subject during the second half of the subject's menstrual cycle; detecting a level of expression of a BCL6 gene product in the sample, an optionally a level of expression of a beta3 integrin gene product in the sample; determining whether or not the endometrium of the subject is in phase or out of phase; correlating the expression level or expression levels detected and whether or not the endometrium of the subject is in phase or out of phase with receptivity of the endometrium of the subject; and determining whether the subject is a candidate for implantation of an embryo based on the correlating step, wherein the determining step identifies the subject as a candidate for implantation of an embryo.

The presently disclosed subject matter also provides methods for identifying an increased risk for implantation failure in a subject, in some embodiments identifying an increased risk for implantation failure subsequent to in vitro fertilization (IVF) and/or frozen embryo transfer (FET). In some embodiments, the presently disclosed methods comprise determining a beta3 status, a BCL6 status, and a endometrial phase status for a subject (including but not limited to a subject undergoing IVF and/or FET treatment), wherein an abnormal BCL6 status in the subject and/or an abnormal beta3 status accompanied by in phase histological phase status is indicative of increased risk for implantation failure in the subject.

As used herein, the phrase "beta3 status" refers to an assessment of beta3 expression in the endometrium of a subject, in some embodiments in the endometrium of a subject during the second half of the subject's menstrual cycle. In some embodiments, a subject's beta3 status is considered normal if the level of expression of beta3 in the endometrium of the subject is within the range of normal variation seen in subjects of the same species at the same point in their menstrual cycles. In some embodiments, a subject's beta3 status is considered abnormal if the level of expression of beta3 in the endometrium of the subject is below a pre-selected cut-off relative to normal variation seen in subjects of the same species at the same point in their menstrual cycles. In some embodiments, the pre-selected cut-off is an HSCORE calculated as set forth herein.

Similarly, as used herein, the phrase "BCL6 status" refers to an assessment of BCL6 expression in the endometrium of a subject, in some embodiments in the endometrium of a subject during the second half of the subject's menstrual cycle. In some embodiments, a subject's BCL6 status is considered normal if the level of expression of BCL6 in the endometrium of the subject is within the range of normal variation seen in subjects of the same species at the same point in their menstrual cycles. In some embodiments, a subject's BCL6 status is considered abnormal if the level of expression of BCL6 in the endometrium of the subject is higher than a pre-selected cut-off relative to normal variation seen in subjects of the same species at the same point in their menstrual cycles. In some embodiments, the pre-selected cut-off is an HSCORE calculated as set forth herein.

As used herein, the phrase "endometrial phase status" refers to whether the subject's endometrium is in phase or out of phase. Endometrial phase is determined in some embodiments by histological analysis of endometrial biopsies at particular stages of the menstrual cycle. Histology "in phase" means that the histomorphology of the endometrium is reflective of the day of the cycle the endometrial biopsy was taken. The histomorphology of the endometrium changes in a characteristic manner through the cycle, allowing one to assign a "cycle day" to the subject. When endometrium is out of phase, the histomorphology of the biopsy appears as though the biopsy was taken at an earlier cycle day. In some embodiments, a subject's endometrial phase status is deemed out of phase if an endometrial biopsy is more than 2 or in some embodiments more than 3 days out of phase. Conversely, in some embodiments a subject's endometrial phase status is deemed in phase if an endometrial biopsy is less than 2 or in some embodiments less than 3 days out of phase. Stated another way, a subject's endometrial phase status can be determined by evaluating endometrial biopsies in the context of timing of ovulation and/or the onset of the next menstrual period. In some embodiments, samples are judged as "out of phase" if histologic dating was delayed by 2 or in some embodiments 3 or more days relative to the predicted day of the menstrual cycle, and/or if subnuclear vacuoles are present.

The presently disclosed subject matter also provides methods for detecting endometrial receptivity to embryo implantation in a subject, optionally a subfertile subject. The phrase "endometrial receptivity" refers to a period in which the endometrium acquires an ability to receive an embryo and allow it to successfully implant therein. In humans, the endometrium acquires this state simultaneously with the development of decidualization in the stromal compartment (Popovici et al., 2000), which is mainly due to the presence of progesterone after proper sensitization with 17P-estradiol. This period, called the "window of implantation", typically lasts from 4-5 days to 9-10 days after production of or progesterone administration in humans. The receptive window in humans is thus limited in this way to menstrual cycle days 19-24 (Navot et al., 1991).

Generally, the endometrial receptivity occurs during a period of the menstrual cycle in which BCL6 gene expression is induced (i.e., during the second half of the menstrual cycle). Endometrial receptivity is negatively affected by the presence of endometriosis, however (see Olive & Schwartz, 1993), and reports from several in vitro fertilization (IVF)/embryo transfer programs indicate patients with endometriosis have decreased implantation rates (Hahn et al., 1986; Simon et al., 1994; Arici et al., 1996). As disclosed herein, BCL6 overexpression is associated with the presence of endometriosis, and thus BCL6 can be employed as a biomarker for the presence of endometriosis and hence, can also be employed for detecting endometrial receptivity to embryo implantation.

As such, in some embodiments a method for detecting endometrial receptivity to embryo implantation comprises determining whether or not a subject seeking to undergo an assisted reproductive technology involving embryo transfer overexpresses BCL6 during the second half of her menstrual cycle. In some embodiments, such a methods comprises (a) obtaining a sample of endometrium from the subject, wherein the sample is isolated from the subject during the second half of the subject's menstrual cycle; (b) detecting an expression level of a BCL6 gene product in the sample; and (c) correlating the expression level of the BCL6 gene product in the sample with endometrial receptivity, wherein overexpression of the BCL6 gene product in the sample as compared to expression of the BCL6 gene product in a sample of endometrium isolated from a normally receptive control subject is indicative of reduced receptivity of the endometrium in the subject.

Since the presence of endometriosis has been associated with infertility, the presently disclosed subject matter also provides methods for facilitating a diagnosis of infertility in a mammal Here as well, in some embodiments a method for facilitating a diagnosis of infertility in a mammal comprises determining whether or not an infertile overexpresses BCL6 during the second half of her menstrual cycle. In some embodiments, the presently disclosed methods comprise (a) obtaining a sample of endometrium from the mammal, wherein the sample is isolated from the mammal during the second half of the mammal's menstrual cycle; (b) detecting expression of BCL6 in the sample; and (c) correlating overexpression of BCL6 in the sample with infertility.

Furthermore, as disclosed herein, BCL6 is a specific and sensitive biomarker for the presence of endometriosis in a subject. As such, the presently disclosed subject matter also provides methods for detecting the presence of endometriosis in a subject by determining whether or not a subject overexpresses BCL6 during the second half of her menstrual cycle. In some embodiments, the presently disclosed methods comprise providing a sample of endometrium from the subject, wherein the sample comprises endometrium isolated from the subject during the second half of the subject's menstrual cycle; detecting a level of expression of a BCL6 gene product in the sample; and correlating the expression level of the BCL6 gene product in the sample with the presence of endometriosis in the subject, wherein overexpression of the BCL6 gene product in the sample as compared to expression of the BCL6 gene product in a sample of similarly timed endometrium isolated from a normal control subject is indicative of the presence of endometriosis in the subject.

Additionally, in some embodiments the presently disclosed subject matter provides methods for managing treatment of a subject with potential endometriosis, subfertility, or both endometriosis and subfertility. In some embodiments, the presently disclosed methods comprise providing a subject suspected of having endometriosis, subfertility, or both endometriosis and subfertility; detecting the presence or absence of the biomarker BCL6 and optionally also detecting the presence of absence of the biomarker beta3 in a sample from the subject; and managing the treatment of the subject based on the detecting.

Managing treatment can comprise selecting appropriate time frames in which to schedule additional studies, such as, but not limited to biopsies and surgery, for the subject. Managing treatment can further comprise selecting an appropriate time frame in which to schedule a repeat assessment of biomarker level(s). Managing treatment can comprise monitoring a fertility patient's receptivity to implantation based on the BCL6 biomarker, optionally also based on the beta3 biomarker, as well as identifying infertility patients who will be helped by surgery using the BCL6 biomarker optionally in conjunction with the beta3 biomarker. In some embodiments, managing treatment can comprise monitoring success of a particular treatment for endometriosis and thus guiding the physician to consider a different treatment for a particular patient (based on repeated testing, for example).

Disclosed herein is the observation that overexpression of BCL6 (for example, expression that is associated with an HSCORE above a pre-selected cut-off) is highly sensitive for the presence of endometriosis, and further implies the need for surgical management and/or retest to show effectiveness of surgery. It is noted that some endometrioses are difficult to detect because the endometriosis is deep within the tissue and/or because the lesions are small and/or are diffusely present.

In some embodiments, a combination of strong BCL6 staining (i.e., BCL6 expression that exceeds a pre-determined cut-off) and absent beta3 staining (i.e., beta3 expression that does not exceed a pre-determined cut-off) correlates with endometriosis-related infertility due to endometrial dysfunction. In such cases and in some embodiments, surgery to treat infertility can be warranted.

In some embodiments, it was observed that a combination of absent BCL6 and absent beta3 staining (with histomorphology consistent with early secretory phase or proliferative phase) is non-diagnostic.

In accordance with some embodiments of the presently disclosed subject matter, provided is a method for monitoring a fertility patient's receptivity to implantation based on one (i.e., BCL6) or optionally two (i.e., BCL6 and beta3) biomarkers, as well as a method for identifying infertility patients who will be helped by surgery and/or medical treatment(s) using the same two markers.

In accordance with the presently disclosed subject matter, BCL6 is highly sensitive, and highly specific. In some embodiments, BCL6 is a marker for endometrial dysfunction (greatly reduced receptivity to embryo implantation). By far, the disorder frequently seen in association with endometrial dysfunction (and its likely cause) is endometriosis. However, hydrosalpinx, which causes similar endometrial dysfunction, is also associated with positive BCL6 staining So, in accordance with some embodiments of the presently disclosed subject matter, provided is a test for endometriosis and/or endometrial dysfunction in infertile women. In some embodiments, BCL6 can also be employed as a biomarker in women who are not trying to conceive.

Beta3 testing, such as in the fairly rare Type II defect, can be highly specific, but also can be poorly sensitive for an implantation defect. In some embodiments of the presently disclosed subject matter, beta3 provides additional specificity and sensitivity, particularly when positive.

The presence and/or expression level of each of the presently disclosed biomarkers can be determined in a variety of animal tissues. In some embodiments, the biomarkers can be detected and/or quantified in animal tissue or bodily fluids. In some embodiments, the biomarkers can be detected and/or quantified in tissue.

Any suitable method can be employed for determining the presence and/or expression level of each of the biomarkers, as would be apparent to one skilled in the art upon a review of the present disclosure. For example, methods for detecting and/or quantified biomarkers can include, but are not limited to, polymerase chain reaction (PCR)-based techniques, gas chromatography (GC), liquid chromatography/mass spectroscopy (LC-MS), gas chromatography/mass spectroscopy (GC-MS), nuclear magnetic resonance (NMR), magnetic resonance imaging (MRI), Fourier Transform InfraRed (FT-IR), and inductively coupled plasma mass spectrometry (ICP-MS). It is further understood that mass spectrometry techniques include, but are not limited to, the use of magnetic-sector and double focusing instruments, transmission quadrapole instruments, quadrupole ion-trap instruments, time-of-flight instruments (TOF), Fourier transform ion cyclotron resonance instruments (FT-MS), and matrix-assisted laser desorption/ionization time-of-flight mass spectrometry (MALDI-TOF MS).

In some embodiments, protein biomarkers can be detected and/or quantified using technologies well known to those of skill in the art such as gel electrophoresis, immunohistochemistry, and antibody binding. Methods for generating antibodies to a polypeptide of interest (e.g., a BCL6 peptide or polypeptide or a beta 3 peptide or polypeptide) are well known to those of ordinary skill in the art. An antibody against a protein biomarker of the presently disclosed subject matter can be any monoclonal or polyclonal antibody, so long as it suitably recognizes the protein biomarker. In some embodiments, antibodies are produced using the protein biomarker as the immunogen according to any conventional antibody or antiserum preparation process. The presently disclosed subject matter provides for the use of both monoclonal and polyclonal antibodies. In addition, a protein used herein as the immunogen is not limited to any particular type of immunogen. For example, fragments of the protein biomarkers of the presently disclosed subject matter can be used as immunogens. The fragments can be obtained by any method including, but not limited to, expressing a fragment of the gene encoding the protein, enzymatic processing of the protein, chemical synthesis, and the like. Antibodies against the instantly disclosed biomarkers can also be purchased from commercial suppliers such as, but not limited to Santa Cruz Biotechnology, Inc. (Santa Cruz, Calif., United States of America), ABCAM® (Cambridge, Mass., United States of America), Cell Signaling Technology, Inc. (Danvers, Mass., United States of America), Thermo Fisher Scientific Inc. (Rockford, Ill., United States of America), eBioscience, Inc. (San Diego, Calif., United States of America), etc.

The antibodies of the presently disclosed subject matter can be useful for detecting and/or quantifying the protein biomarkers. For example, antibody binding can be detected by techniques known in the art (e.g., radioimmunoassay, ELISA (enzyme-linked immunosorbant assay), "sandwich" immunoassays, immunoradiometric assays, gel diffusion precipitation reactions, immunodiffusion assays, in situ immunoassays (e.g., using colloidal gold, enzyme or radio-isotope labels, for example), Western blots, precipitation reactions, agglutination assays (e.g., gel agglutination assays, hemagglutination assays, etc.), complement fixation assays, immunofluorescence assays, protein A assays, flow cytometry, and immunoelectrophoresis assays, etc. One example of an immunoassay is described in U.S. Pat. Nos. 5,599,677 and 5,672,480, the disclosure of each of which is herein incorporated by reference. Upon review of the present disclosure, those skilled in the art will be familiar with numerous specific immunoassay formats and variations thereof that can be useful for carrying out the methods of the presently disclosed subject matter.

As such, in some embodiments the presently disclosed subject matter provides methods for detecting the presence of endometriosis, subfertility, or both endometriosis and subfertility in a subject by assaying for the presence or absence of the presently disclosed biomarkers. In some embodiments, the presently disclosed methods comprise (a) providing a subject suspected of having endometriosis, subfertility, or both endometriosis and subfertility; (b) detecting the presence or absence of biomarker BCL6, optionally biomarkers BCL6 and beta3, in a sample from the subject; and (c) determining the presence of endometriosis, subfertility, or both endometriosis and subfertility in the subject based on the detecting in step (b).

In some embodiments of the presently disclosed subject matter, a kit is provided for measuring the presence and/or amount of one or more biomarkers in a sample of the subject. In some embodiments, the kit can comprise (i) detection molecules specific for a biomarker; and (ii) directions for measuring the presence or amount of a biomarker. In some embodiments, the kit can also include directions for using the determined biomarker levels in managing treatment. The phrase "detection molecule" is used herein in its broadest sense to include any molecule that can bind with sufficient specificity to one of the biomarkers to allow for detection of the particular biomarker in the presence or absence of the other biomarker. To allow for detection can mean to determine the presence or absence of the particular biomarker and, in some embodiments, can mean to determine the amount of the particular biomarker. Detection molecules can include antibodies, antibody fragments, and nucleic acid molecules (such as but not limited to primers for PCR approaches or probes). In some embodiments, the detection molecules comprise a conjugated detectable group. In some embodiments, the detection molecules comprise antibodies specific for each of the protein biomarkers.

Approaches for producing a detectable signal include the use of radioactive labels (e.g., $^{32}P$, $^{35}S$, $^{125}I$, $^{131}I$), enzyme labels (e.g., horseradish peroxidase, alkaline phosphatase), fluorescent labels (e.g., fluorescein, rhodamine, and fluorophores of the ALEXA-FLUOR® brand series of fluorescent dye labels available from the MOLECULAR PROBES® division of Thermo Fisher Scientific Inc., Eugene, Oreg., United States of America) and so forth, in accordance with known techniques, as will be apparent to one skilled in the art upon review of the present disclosure. Many methods are known in the art for detecting binding in an immunoassay or in a nucleic acid assay, and are within the scope of the presently disclosed subject matter.

In some embodiments, direct detection methods are provided, such as, for example, wherein the detection molecule is a primary antibody specific for a biomarker and detection is by using a label present on the primary antibody. In some embodiments, the detection molecule can be detected using an indirect method such as using a labeled secondary antibody that detects the presence of the primary antibody by binding to the primary antibody per se. For example, if the primary antibody is a mouse monoclonal antibody that is specific for a biomarker of the presently disclosed subject matter, a detectably labeled anti-mouse antibody (e.g., an anti-mouse IgG or IgM secondary antibody raised in a species other than mice) can be used to detect the presence of the primary antibody bound to the biomarker.

In some embodiments, the presence or absence of the biomarkers BCL6 and beta3 are determined simultaneously. This can be accomplished in some embodiments by conjugating differently detectable labels to an anti-BCL6 primary antibody and an anti-beta3 primary antibody. In some embodiments, this can be accomplished by using unlabeled primary antibodies that can be differentially detected using secondary antibodies that are conjugated to different detectable labels. In some embodiments, the presence or absence of the biomarkers BCL6 and beta3 are determined sequentially, for example by detecting BCL6 expression in one section of an endometrial biopsy and detecting beta3 expression in a serial section of the same endometrial biopsy. Serial sections can be assayed on separate slides or on the same slide provided that the slide contains a barrier to prevent intermixing of reagents.

Thus, the detection molecule can in some embodiments be detected using an indirect method such as by detecting binding of a specific binding partner to the detection molecule. The specific binding partner can be any molecule that binds with sufficient specificity to the detection molecule to allow for detection of the particular detection molecule in the presence or absence of the detection molecules for the other biomarker. In some embodiments, the detection molecule is a primary antibody and the primary antibody can be detected by detecting binding of a secondary antibody or a reagent or other specific binding partner to the primary antibody. For example, in some embodiments the specific binding partner can be a secondary antibody that recognizes the detection molecule that is a primary antibody. In some embodiments the specific binding partner can be a molecule that specifically binds to a group on the detection molecule such as, for example, a biotin group on the detection molecule. In some embodiments, the binding partner can be labeled. In some embodiments, the binding partner is a secondary antibody that can be labeled.

As such, indirect detection methods can in some embodiments involve a detection molecule that is an unlabeled primary antibody and a binding partner that is a labeled secondary antibody. This method can be more sensitive than direct detection methods due to signal amplification through more than one secondary antibody reaction with different antigenic sites on the primary antibody. In some embodiments, the indirect detection method is an immunofluorescence method, wherein the secondary antibody can be labeled with a fluorescent dye such as FITC, rhodamine, Texas red, or an ALEXA-FLUOR® dye. In some embodiments, the indirect detection method is an immunoenzyme method, wherein the secondary antibody can be labeled with an enzyme such as peroxidase, alkaline phosphatase, or glucose oxidase.

In some embodiments, an immunoassay can comprise antibodies specific for one or more biomarkers and an approach for producing a detectable signal. In some embodiments, the antibodies can be immobilized on a support (such as a bead, plate, or slide) in accordance with known techniques, and contacted with a test sample in liquid phase. The support can then be separated from the liquid phase and either the support phase or the liquid phase can be examined for the detectable signal that is related to the presence of the biomarker.

Accordingly, in some embodiments a sample is a tissue section and the detecting step comprises immunohistochemically staining the sample with a primary antibody that binds to a BCL6 gene product or a beta3 gene product and detecting binding of the primary antibody to the BCL6 gene product or the beta3 gene product. In some embodiments, the primary antibody comprises a detectable label and detecting binding of the primary antibody to the BCL6 gene product or a beta3 gene product comprises detecting the detectable label. In some embodiments, detecting binding of the primary antibody to the BCL6 gene product or the beta3 gene product comprises detecting a complex of the primary antibody and the BCL6 gene product or the beta3 gene product using a labeled secondary antibody that is specific for the primary antibody. In some embodiments, the sample to be assayed for BCL6 and/or beta3 gene expression is a cell extract and the contacting and detecting steps comprise immunoblotting with a primary antibody comprising a detectable label that is specific for the BCL6 gene product or the beta3 gene product and detecting the detectable label; or immunoblotting with a primary antibody that is specific for the BCL6 gene product or the beta3 gene product and detecting the primary antibody indirectly with a labeled secondary antibody that binds to the primary antibody.

In some embodiments, the results of the various antibody-based assays are expressed in terms of a "histochemistry score", also known as an HSCORE. HSCOREs are expressions of antibody staining intensity, and are broadly discussed in Lessey et al., 1992. By way of example and not limitation, in some embodiments an HSCORE is calculated using the following equation:

$$HSCORE = \Sigma Pi(i+1)/100$$

where i=the intensity of staining of cells in the sample with a value of 1 being low staining, 2 being moderate staining, and 3 being strong staining, and Pi being the percentage of stained cells in the sample for each intensity, varying from 0-100%. An HSCORE can function as a pre-determined cut-off such that expression above or below a pre-determined HSCORE in a particular subject for a particular biomarker can permit that subject's status for that biomarker to be identified as "normal" vs. "abnormal", positive vs. negative, or any other discriminator. With respect to BCL6, for example, in some embodiments an abnormal BCL6 status comprises an HSCORE for the subject with respect to BCL6 gene product expression during the second half of the subject's menstrual cycle that is greater than a pre-determined cut-off value, which in some embodiments can be selected from the group consisting of 1.0, 1.1, 1.2, 1.3, 1.4, 1.5, 1.6, 1.7, 1.8, 1.9, and 2.0. In some embodiments, a pre-determined cut-off for BCL6 expression is an HSCORE of 1.4. Similarly, with respect to beta3, in some embodiments an abnormal beta3 status comprises an HSCORE for the subject with respect to beta3 gene product expression during the second half of the subject's menstrual cycle that is less than a pre-determined cut-off value. In some embodiments, an HSCORE for the subject with respect to beta3 gene product expression during the second half of the subject's menstrual cycle that is less than a pre-determined cut-off value, which in some embodiments can be selected from the group consisting of 0.1, 0.2, 0.3, 0.4, 0.5, 0.6, 0.7, 0.8, 0.9, 1.0, 1.1, or 1.2. In some embodiments, a pre-determined cut-off for beta3 expression is an HSCORE of 0.7.

The presently disclosed subject matter also provides in some embodiments methods for increasing the likelihood of implantation of an embryo in a subject with decreased endometrial receptivity due to overexpression of a BCL6 gene product during the second half of the subject's menstrual cycle. In these embodiments, a subject with decreased endometrial receptivity due to increased BCL6 expression is provided, and an effective treatment to reduce or eliminate the overexpression of the BCL6 gene product and/or its biological consequences is administered. In some embodiments, the treatment is surgical and/or medical treatment of the resulting endometriosis. In some embodiments, the treatment comprises surgical removal of endometriosis present within the subject, optionally by laparoscopy. In some embodiments, the treatment comprises administering to the subject an effective amount of a gonadotropin-releasing hormone (GnRH) agonist, optionally Leuprorelin (INN) (also known as leuprolide acetate, sold under the trade name LUPRON® by Abbott Laboratories Corp., North Chicago, Ill., United States of America).

In some embodiments, the treatment comprises administering an effective amount of a BCL6 inhibitor to the subject. In some embodiments, a lack of beta3 expression in the subject is also treated in the subject, for example by administering to the subject an effective amount of an aromatase inhibitor such as but not limited to Letrozole (4,4'-((1H-1,2,4-triazol-1-yl)methylene)dibenzonitrile; see Miller et al., 2012). Treatment with the aromatase inhibitor can occur before, concurrently with, or after the treatment designed to address BCL6 overexpression.

The presently disclosed subject matter also provides in some embodiments methods for assessing the effectiveness of an infertility treatment. In some embodiments, the methods comprise assessing BCL6 expression in an infertile subject, administering a treatment designed to reduce or eliminate endometriosis in the subject, and re-assessing BCL6 expression in an infertile subject subsequent to the treatment to determine of the treatment reduced BCL6 expression in the subject. In some embodiments, BCL6 expression is sufficiently reduced by the treatment, and transfer of an embryo to the subject can be performed. In some embodiments, BCL6 expression is not adequately reduced in the subject, and a second treatment designed to reduce or eliminate endometriosis in the subject is administered. In some embodiments the second treatment is the same treatment as the first treatment, and in some embodiments the second treatment is a different treatment than the first treatment. In some embodiments, BCL6 status is again assessed after the second treatment, and if BCL6 expression is sufficiently reduced by the treatment, transfer of an embryo to the subject can be performed. In some embodiments, BCL6 expression is still not adequately reduced in the subject, and the subject is either retreated or is deemed insufficiently receptive to embryo transfer at least at that time.

The presently disclosed subject matter includes kits for detecting each of the biomarkers. In some embodiments, the kit can comprise detection molecules, such as antibodies or nucleic acid molecules (such as but not limited to primers for PCR approaches and probes) specific for the biomarkers, the reagents necessary for producing a detectable signal as described above, and appropriate buffers. In some embodiments, the kit can contain all of the components necessary to perform a detection assay, including all controls, directions for performing assays, any necessary software for analysis of the data generated by the presently disclosed methods, and for presentation of the results. Indeed, in some embodiments the presently disclosed methods are performed and/or the kits are employed using a suitably programmed computer, in some aspects.

Detection kits for carrying out the methods of the presently disclosed subject matter can be produced in a number of ways. In some embodiments, the detection kit can comprise a detection molecule that is an antibody or antibody fragment that specifically binds to a protein biomarker as disclosed herein immobilized on a solid support, and a second antibody or antibody fragment specific for the first antibody or antibody fragment conjugated to a detectable group. In some embodiments, the kit can also include ancillary reagents such as buffering agents and protein stabilizing agents, and can include (where necessary) other members of the detectable signal-producing system of which the detectable group is a part (e.g., enzyme substrates); agents for reducing background interference in a test; control reagents; apparatus for conducting a test, and the like, as will be apparent to those skilled in the art upon a review of the instant disclosure.

In some embodiments, the detection kit can comprise antibodies or antibody fragments specific for each of the presently disclosed protein biomarkers, and a specific binding partner for each of the antibodies that is conjugated to a detectable group. Ancillary agents as described above can likewise be included. The test kit can be packaged in any suitable manner, typically with all groups in a single container along with a sheet or printed instructions for carrying out the test.

In some embodiments, the detection assay for the biomarker(s) can be automated. Methods for the automation of immunoassays include those described in U.S. Pat. Nos. 5,885,530, 4,981,785, 6,159,750, and 5,358,691, each of which is herein incorporated by reference. In some embodiments, analysis of the biomarker data in combination with assessing histomorphology and presentation of results can also be automated. In this manner, a clinician can access the test results using any suitable approach or device. Thus, in some embodiments, a clinician need not understand the raw data, as the data can be presented directly to the clinician in its most useful form. The clinician is then able to immediately utilize the information to optimize care of the subject. The presently disclosed subject matter provides any method, system, and/or apparatus capable of receiving, processing, and transmitting the information to and from laboratories conducting the assays, information providers, medical personnel, and subjects.

EXAMPLES

The following EXAMPLES provide illustrative embodiments. Certain aspects of the following EXAMPLES are disclosed in terms of techniques and procedures found or contemplated by the present inventors to work well in the practice of the embodiments. In light of the present disclosure and the general level of skill in the art, those of skill will appreciate that the following EXAMPLES are intended to be exemplary only and that numerous changes, modifications, and alterations can be employed without departing from the scope of the presently claimed subject matter.

Materials and Methods for the Examples

Human Tissues. All endometrium was obtained from ongoing prospective studies at the University of North Carolina at Chapel Hill (Chapel Hill, N.C., United States of America) and Greenville Health System (Greenville, S.C., United States of America). All protocols for collection of these samples were approved by the Institutional Review Boards at both institutions and written consent was obtained from each subject prior to endometrial biopsy.

Human endometrium was obtained for several purposes: normal controls were recruited from the general population and were excluded if they had known anatomic or functional reproductive tract abnormalities, had taken medications known to affect reproductive hormones during the previous 3 months, or if they were obese (defined as body mass index [BMI]≥30). These normally cycling (25-35 days) controls were randomized to undergo pipelle endometrial sampling during the proliferative (P), early (ES), mid secretory (MS) phase, or late secretory (LS) phase determined by the last menstrual period for proliferative samples or urinary luteinizing hormone (LH) monitoring for secretory samples. ES was defined as the day of positive LH surge plus 2-6 days (LH+2-6), MS as LH surge plus 8-10 days (LH+8-10) and LS as LH surge plus 11-12 days (LH+11-12). Endometrial biopsy tissue was divided into aliquots, with larger fractions either snap frozen in liquid nitrogen for RNA analysis or used for separation of endometrial epithelium (EEC) and endometrial stroma (ESC) by enzymatic digestion and filtration as described in previous literature (Irwin et al., 1994; Ryan et al., 1994), unless otherwise specified.

A separate set of normal endometrium was obtained prospectively between cycle day 19 to 24 of the menstrual cycle based on urinary LH-surge testing, in normally cycling and fertile volunteers with at least one successful pregnancy. These samples were read by three separate pathologists and all were confirmed to be within 2 days of the expected date according to the endometrial dating criteria set forth in Noyes et al., 1950.

Abnormal endometrium was obtained in three separate protocols. The first set was used for comparison of BCL6 expression in various stages of endometriosis compared to controls throughout the menstrual cycle. These were obtained immediately before surgery for pelvic pain or infertility. In these cases, the stage of endometriosis, when present, was assigned and the phase of the menstrual cycle determined by the date of the last menstrual cycle and histological dating according to the criteria set forth in Noyes et al., 1950. Cases without endometriosis were included and compared. A second set of mid-secretory samples came from women undergoing laparoscopy for pelvic pain or infertility. A third set of samples were from women who were prospectively recruited with normal menstrual cycles, partners with normal semen analyses, and at least one patent fallopian tube. These included women with otherwise unexplained infertility and were compared to fertile controls from the same time in the mid-secretory phase. These data were used to generate ROC analysis and to estimate sensitivity, specificity, and positive and negative predictive values for BCL6 as a test for endometriosis.

RNA Isolation and Quantification. Total RNA from cultured cells or endometrial tissue was isolated from frozen tissue samples using the RNAQUEOUS®-4 brand PCR Kit (AMBION®, Austin, Tex., United States of America), quantification was performed using RIBOGREEN® (INVITROGEN™, Carlsbad, Calif., United States of America) and complementary DNA (cDNA) was synthesized as described in Plante et al., 2012. Reverse transcription conditions were 25° C. for 5 minutes, 42° C. for 15 minutes, and 95° C. for 5 minutes.

Quantitative real-time RT-PCR (qRT-PCR) was performed on total RNA using primer-probe sets specific for BCL6 and the constitutively expressed gene cyclophilin (primer-probe sets HS00153368 and HS04194521, respectively; APPLIED BIOSYSTEMS®, Foster City, Calif., United States of America). These primer-probe sets cross introns and, therefore, provide a specific signal from mRNA and not from genomic DNA. Cyclophilin was chosen because previous work suggested that it exhibits little variation across the menstrual cycle.

Each sample of cDNA was diluted 1:5 and plated with 2× Brilliant II QPCR Master Mix (Agilent Technologies, Stratagene Products Division, La Jolla, Calif., United States of America) and sterile water. The total reaction volume for all real-time PCR experiments was 20 μL. Reactions were performed on a Stratagene MX3000P device (Agilent Technologies, Stratagene Products Division, La Jolla, Calif., United States of America) for 1 cycle of 50° C. for 2 minutes, then 95° C. for 10 minutes, followed by 40 cycles of 95° C. for 25 seconds and 60° C. for 1 minute. Threshold cycle (Ct) values were converted to relative expression using the delta-delta Ct method, allowing normalization to both the housekeeping gene, cyclophilin, and a single sample in the proliferative phase.

Immunohistochemistry. Formalin-fixed, paraffin-embedded tissue blocks were sectioned at 4 μm. Slides were stained with hematoxylin-eosin (H&E) and consecutive sections stained with ready-to-use antibodies against BCL6 (clone LN22, Leica Microsystems, Buffalo Grove, Ill., United States of America) utilizing the automated Bond immunostainer platform (Leica Microsystems, Buffalo Grove, Ill., United States of America). Negative control sections were treated with non-immune serum diluted in the same manner and positive controls included lymph node sections. The semi-quantitative assessment of expression was made using the HSCORE (0 to 4), calculated using the following equation: HSCORE=ΣPi (i+1)/100, where i=the intensity of staining with a value of 1, 2, or 3, (weak, moderate, and strong, respectively) and Pi is the percentage of stained epithelial cells for each intensity, varying from 0-100%. The use of HSCORE has previously been validated as a semi-quantitative assay for immunohistochemical staining (see Budwit-Novotny et al., 1986; see also Lessey et al., 1994a; Lessey et al., 1994b; Miller et al., 2012).

Western Blot Analysis. Western blot was performed on human tissue using standard techniques (see e.g., Harlow & Lane, 1988; Coligan, 1991) Membranes were probed with BCL6 primary antibody (Santa Cruz Biotechnology, Inc., Santa Cruz, Calif., United States of America) Immunoreactivity was visualized by incubation with a horseradish peroxidase-linked secondary antibody and developed by enhanced chemiluminescence (ECL) reagents (GE Healthcare Biosciences, Piscataway, N.J., United States of America). To control for loading, the membrane was probed with an anti-Actin antibody (Santa Cruz Biotechnology, Inc.) and developed. Relative intensity analysis was performed using IMAGE STUDIO™ Lite 3.1 (LI-COR, Lincoln, Nebr., United States of America).

Statistical Analyses. Student's t-test and analysis of variance (ANOVA) were used to analyze normally distributed data and Wilcoxon rank sum and Kruskal Wallis tests for non-parametric data using STATA® Statistical software (Version 12.0; StataCorp LP, College Station, Tex., United States of America) with pairwise comparisons for post hoc analysis. Normally distributed data are presented as mean and standard error. Non-parametric data are presented as box plots. Receiver operating characteristic (ROC) curves, sensitivity, and specificity were generated using STATA® and BCL6 cutoff values were chosen based on likelihood ratio testing as well as positive and negative predictive values.

Example 1

BCL6 as a New Biomarker for Detection of Endometrial Receptivity Defects

Immunohistochemical analysis beta3 and BCL6 expression in different clinical situations is shown in FIGS. 1A-1D. In the normal secretory phase, beta3 expression was present (FIG. 1A) and BCL6 expression levels were low (FIG. 1B). In the secretory phase of women with endometriosis and endometrial receptivity defects, beta3 expression was negative in the glandular and luminal epithelium (FIG. 1C), while BCL6 expression was strongly positive (FIG. 1D).

Figure 2:
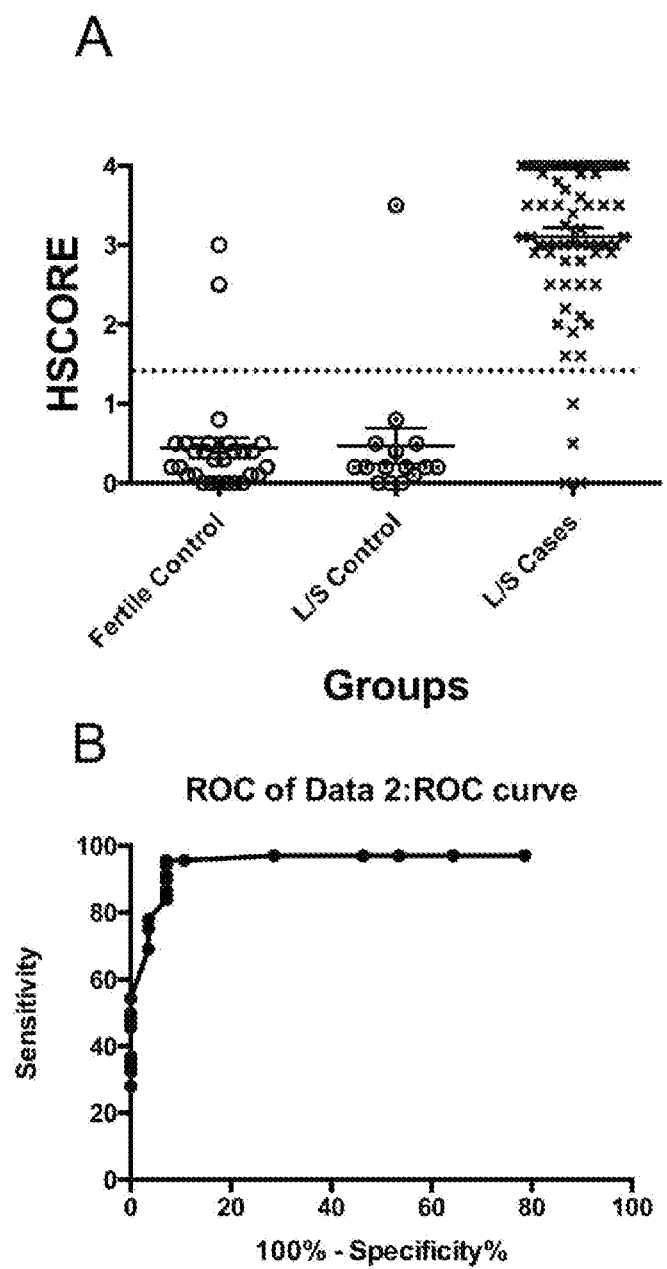
FIG. 2A is a scattergram of BCL6 expression in women with proven fertility (Fertile Control), in women without endometriosis at the time of laparoscopy (L/S Control), and in women with endometriosis at the time of surgery (L/S Cases). All biopsies were read and scored by a blinded observer.
FIG. 2B depicts a receiver operator characteristic (ROC) curve generated from the data presented in FIG. 2A, which suggested a cut-off HSCORE of 1.4 (dotted line in FIG. 2A).

To validate BCL6 as a diagnostic biomarker of abnormal endometrium, relative expression levels of BCL6 in endometrium from women with and without endometriosis were examined. As shown in FIG. 2A, for women with proven fertility (Fertile Control), only 2 of 28 showed BCL6 immunostaining above an HSCORE cut-off of 1.4 suggested by ROC curve analysis. In women without endometriosis at the time of laparoscopy (L/S Control; n=15), BCL6 staining was also uncommon (1 of 15 with an HSCORE greater than 1.4). Women with endometriosis (L/S Cases; n=67) demonstrated a marked increase in BCL6 immunostaining in the secretory phase versus that in either control group (n=29).

Using receiver operating characteristic (ROC) analysis on HSCORE results from the secretory phase in both normal and endometriosis subjects (FIG. 2B), the AUC was 0.939 (95% CI: 0.848-1.030). Based on sensitivity and specificity calculation using an HSCORE cut-off of >1.4 gave a positive likelihood ratio of 14.48 (95% CI 82.24% to 99.91%). Using the cut-off of >1.4 and based on the results in a prospective surgery study, BCL6 positivity had a sensitivity of 93.6% and a specificity of 87.7% for detection of endometriosis. Positive and negative predictive values were 93.6% and 86.6%, respectively (see Table 3).

TABLE 3

Summary of Characteristics of a BCL6-Only Endometriosis Predictor Test

|      |   | +  | −  |
|------|---|----|----|
| BCL6 | + | 59 | 4  |
|      | − | 4  | 26 |

Similar ROC curves for BCL6 messenger RNA (mRNA) expression levels in the proliferative phase, secretory phase, and all phases combined. In the proliferative phase alone (n=13), the area under the ROC curve was found to be 1.0 (95% CI: 1.0-1.0). The sensitivity, specificity, positive predictive value (PPV), and negative predictive value (NPV) were 100%.

It is possible that, with a larger sample size, the area under the curve would be less than 1.0. However, the findings disclosed herein suggested that a test evaluating proliferative phase, eutopic endometrial BCL6 mRNA expression would have high PPV and NPV. In the secretory phase alone (n=33), the area under the ROC curve was 0.885 (95% CI: 0.687-0.974) with a sensitivity of 92%, specificity of 83%, PPV of 84%, and NPV of 91%. When all phases were evaluated together (n=46), the area under the curve was 0.862 (95% CI: 0.6737-0.951), sensitivity of 77%, specificity of 90%, PPV of 89%, and NPV of 80%. In all phases combined, using a BCL6 relative mRNA expression level cutoff of ≤7.24, the negative likelihood ratio was 0.1 and using a cutoff of ≥19.56, the positive likelihood ratio was 7.7.

Example 2

Analyses of BCL6 Gene Expression at Various Menstrual Stages and in Normal Subjects Versus Subjects with Endometriosis Endometrial biopsy tissue was obtained from normal subjects and subjects with endometriosis as set forth herein above (see Materials and Methods for the EXAMPLES). In an first set of analyses, normal endometrial biopsy tissue was separated into aliquots and endometrial epithelium (EEC) and endometrial stroma (ESC) were isolated as described herein above. mRNA was isolated and quantified from whole endometrium, EEC, and ESC as also set forth herein above. The results are presented in FIGS. 3A-3C.

Figure 3A:
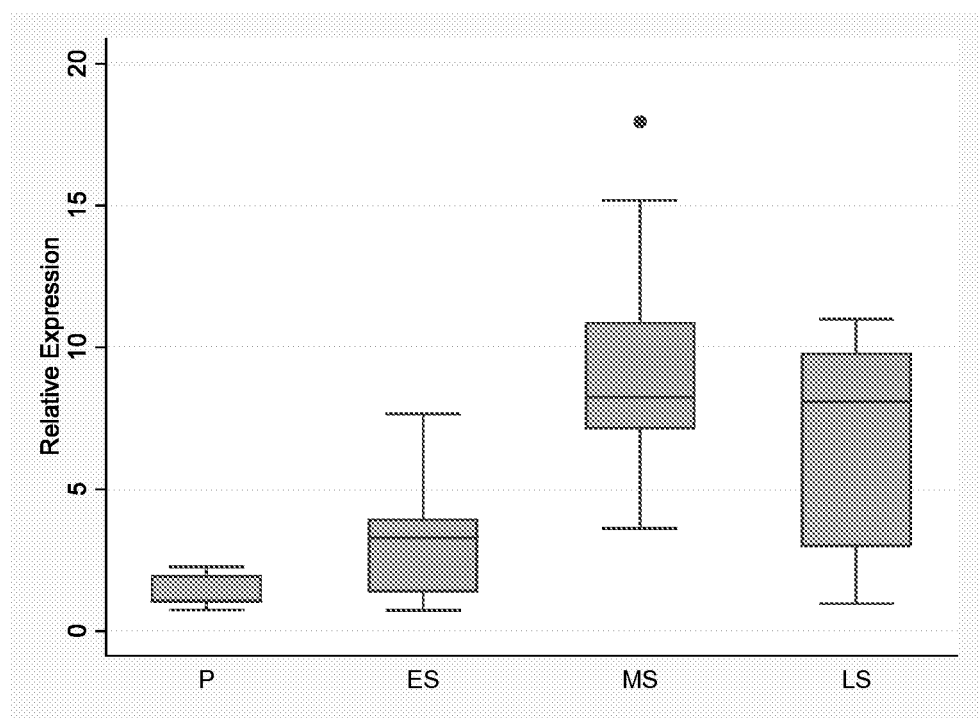
FIGS. 3A-3C depict relative BCL6 mRNA expression levels during different stages of the menstrual cycle of normal controls in various tissue types.
Figure 3B:
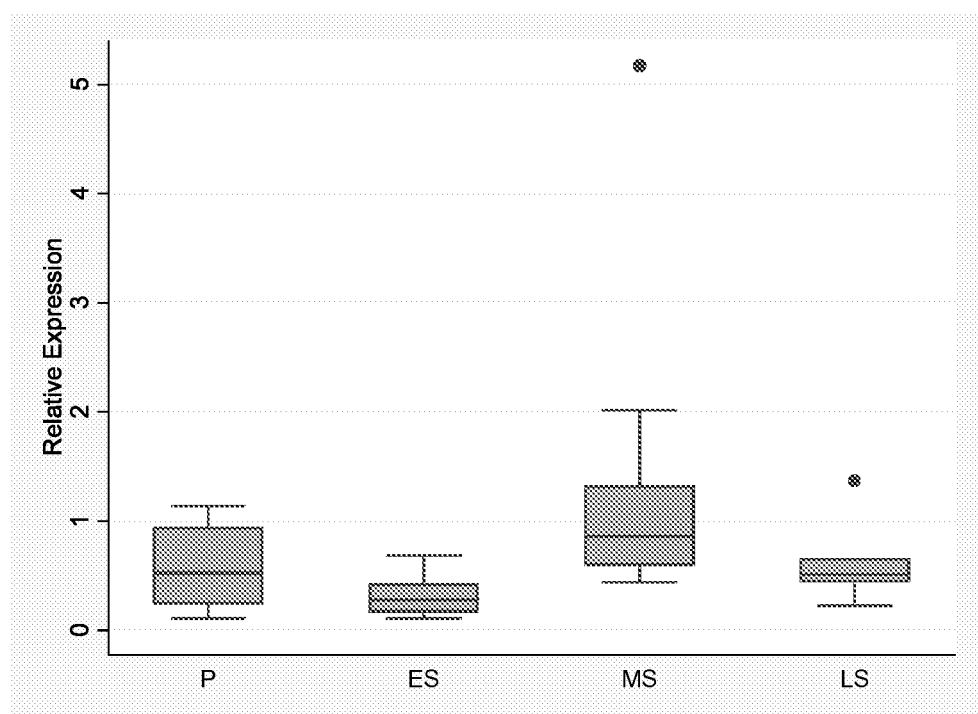
Figure 3C:
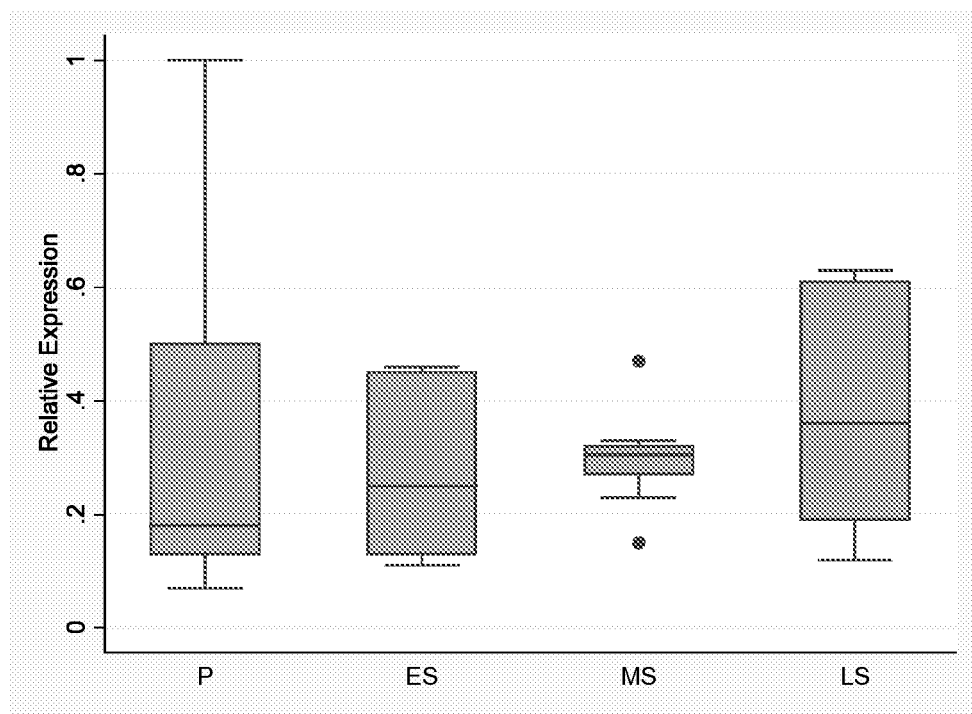

As set forth in FIG. 3A, the relative BCL6 mRNA expression level in whole endometrium was significantly higher in the early, mid, and late secretory phases relative to the proliferative phase (p=0.0005). In EEC, the relative BCL6 mRNA expression levels were less dramatically different between the proliferative phrase and the early, mid, and late secretory phases (p=0.02; see FIG. 3B). In ESC, relative BCL6 mRNA expression levels in the proliferative phase vs. the early, mid, and late secretory phases were not significantly different (p>0.05; see FIG. 3C).

Figure 4:
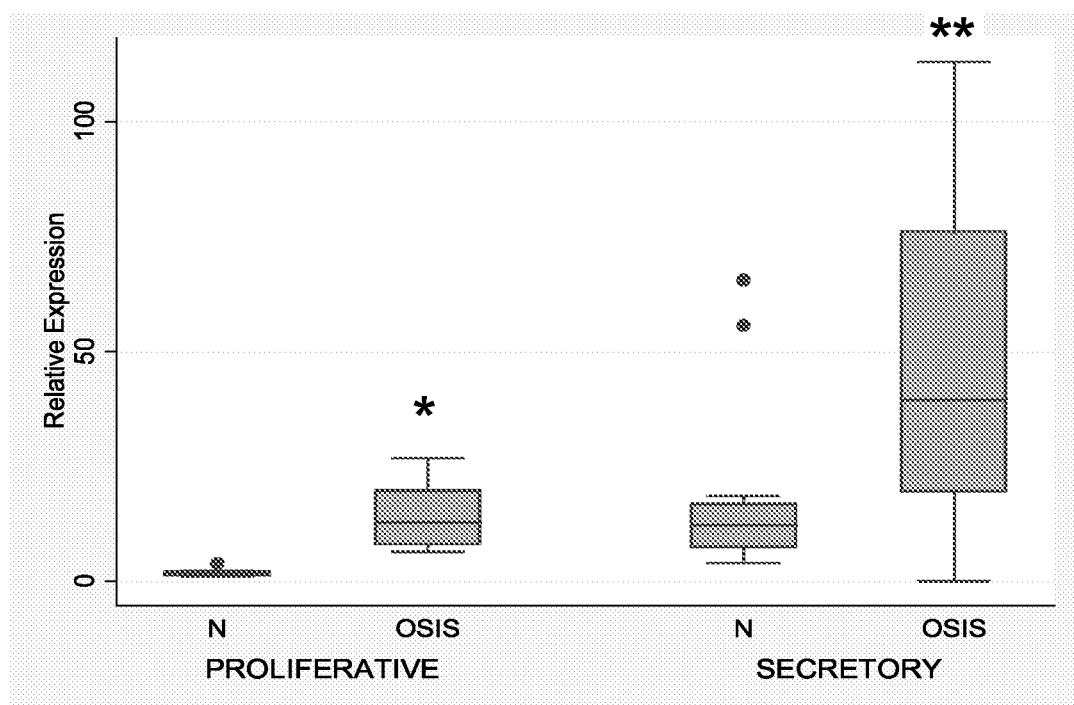
FIG. 4 depicts relative BCL6 mRNA expression levels in normal controls (N) compared to subjects with endometriosis (OSIS) during the proliferative and secretory phases. Boxes represent median and interquartile range (IQR). Whiskers include values within 1.5 times the interquartile range beyond the 25th and 75th percentile. Outliers are represented by individual points (●). *p=0.003 (N vs. OSIS); **p=0.007 (N vs. OSIS).

Relative expression levels of BCL6 in whole endometrium of normal subjects and subjects with endometriosis during the proliferative and secretory phases were also tested. As shown in FIG. 4, subjects with endometriosis had significantly higher expression of BCL6 in both the proliferative (p=0.003) and secretory (p=0.007) phase.

Figure 5A:
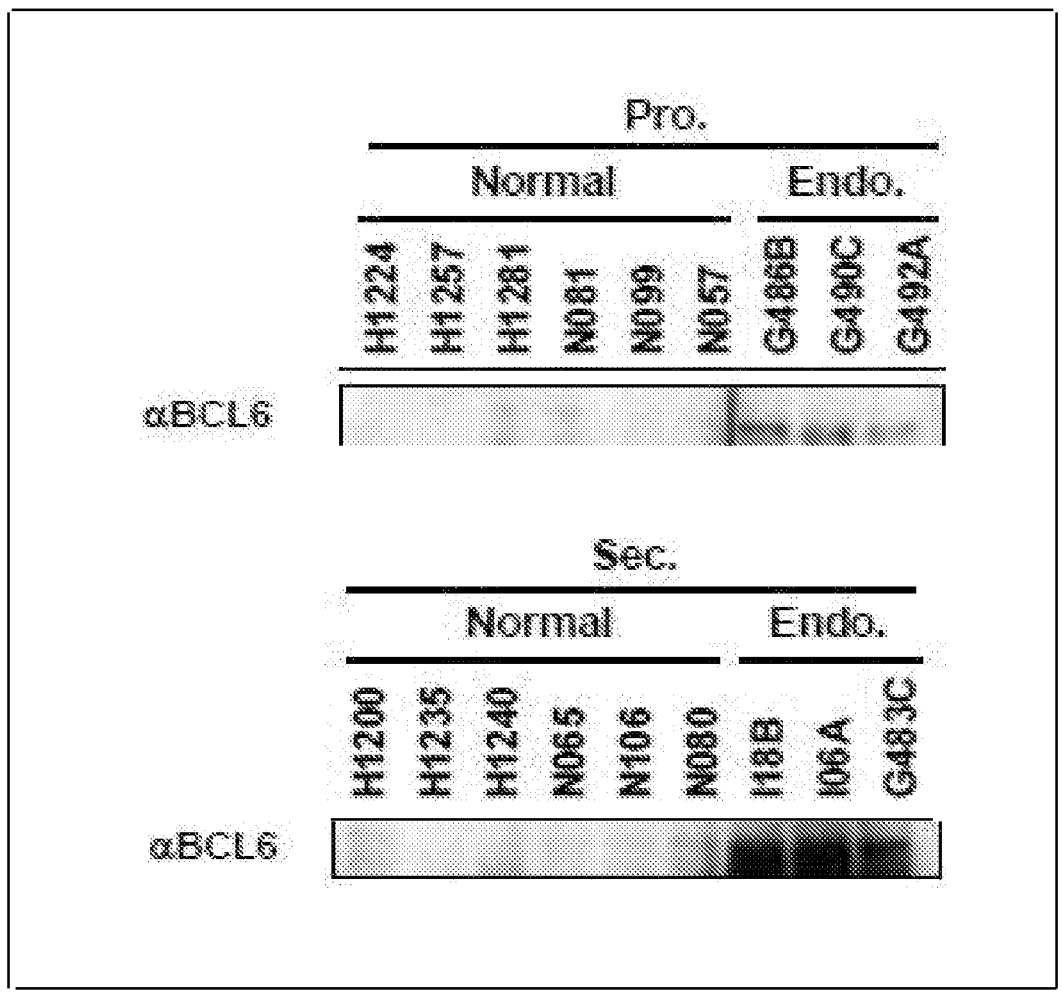
FIG. 5A depicts the results of Western blot analyses demonstrating BCL6 protein expression in proliferative (P) and secretory (Sec) phases of normal controls (Normal) and subjects with endometriosis (Endo.).
Figure 5B:
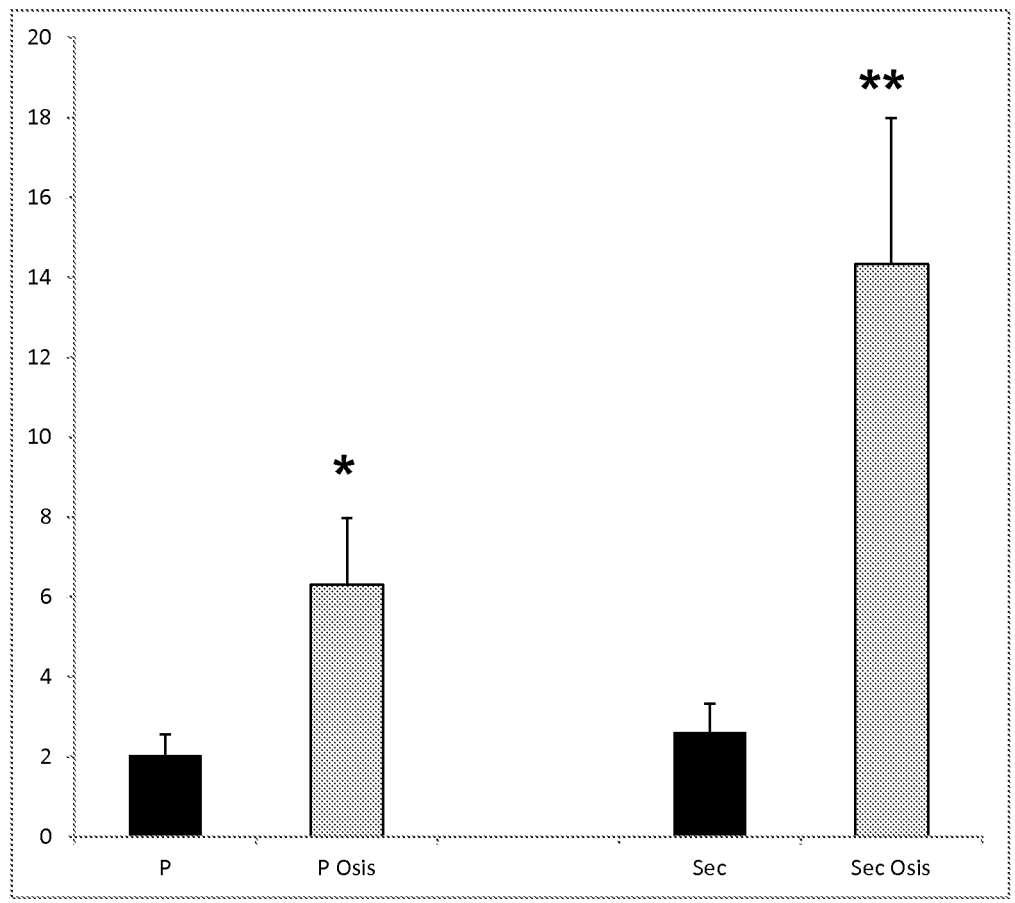
FIG. 5B is a bar graph showing relative intensity analyses of the Western blots of FIG. 5A. Data are mean and standard error.*p=0.02 (P vs. P Osis); **p=0.02 (Sec vs. Sec Osis).

BCL6 expression at the protein level was also tested by Western blot as set forth in more detail herein above. An anti-BCL6 antibody was used to assay for the presence of BCL6 protein in whole endometrium from normal subjects and subjects with endometriosis during the proliferative phase and during secretory phase. As shown in FIG. 5A, BCL6 was more highly expressed in subjects with endometriosis in both the proliferative phase and the secretory phase. FIG. 5B is a bar graph showing relative intensity analyses of the Western blots of FIG. 5A. As set forth therein, the expression of BCL6 in the proliferative and secretory phases in subjects with endometriosis were significantly higher (p=0.02) as compared to these same phases in normal subjects.

Example 3

Beta3 and BCL6 Comparisons in Assisted Reproductive Technology Cycles (ART) Including In Vitro Fertilization (IVF) and Frozen Embryo Transfer (FET)

Direct comparisons between beta3 integrin and BCL6 was performed in 59 fresh and frozen IVF cycles. Patients were included if they had an endometrial biopsy with beta3 and BCL6 testing prior to the initiation of their cycle, and if no treatment aimed at correcting their defects were employed. The types of defects for integrin staining included normal beta3 expression in an "in phase" histology (normal), out of phase histology (Type I defects), and in phase histology (Type II defects) with absent beta3 integrin staining, as previously described (Lessey et al., 1994a,b). The types of defects are based on an HSCORE cut-off of 0.7 (see Lessey et al., 1994a,b). The determination of endometrial receptivity based on BCL6 had only two outcomes: Normal and Positive. A normal result was an HSCORE of <1.4 while a positive BCL6 (denoting poor endometrial receptivity) was designated by an HSCORE equal to or greater than 1.4 (see FIGS. 6A and 6B).

Figure 6:
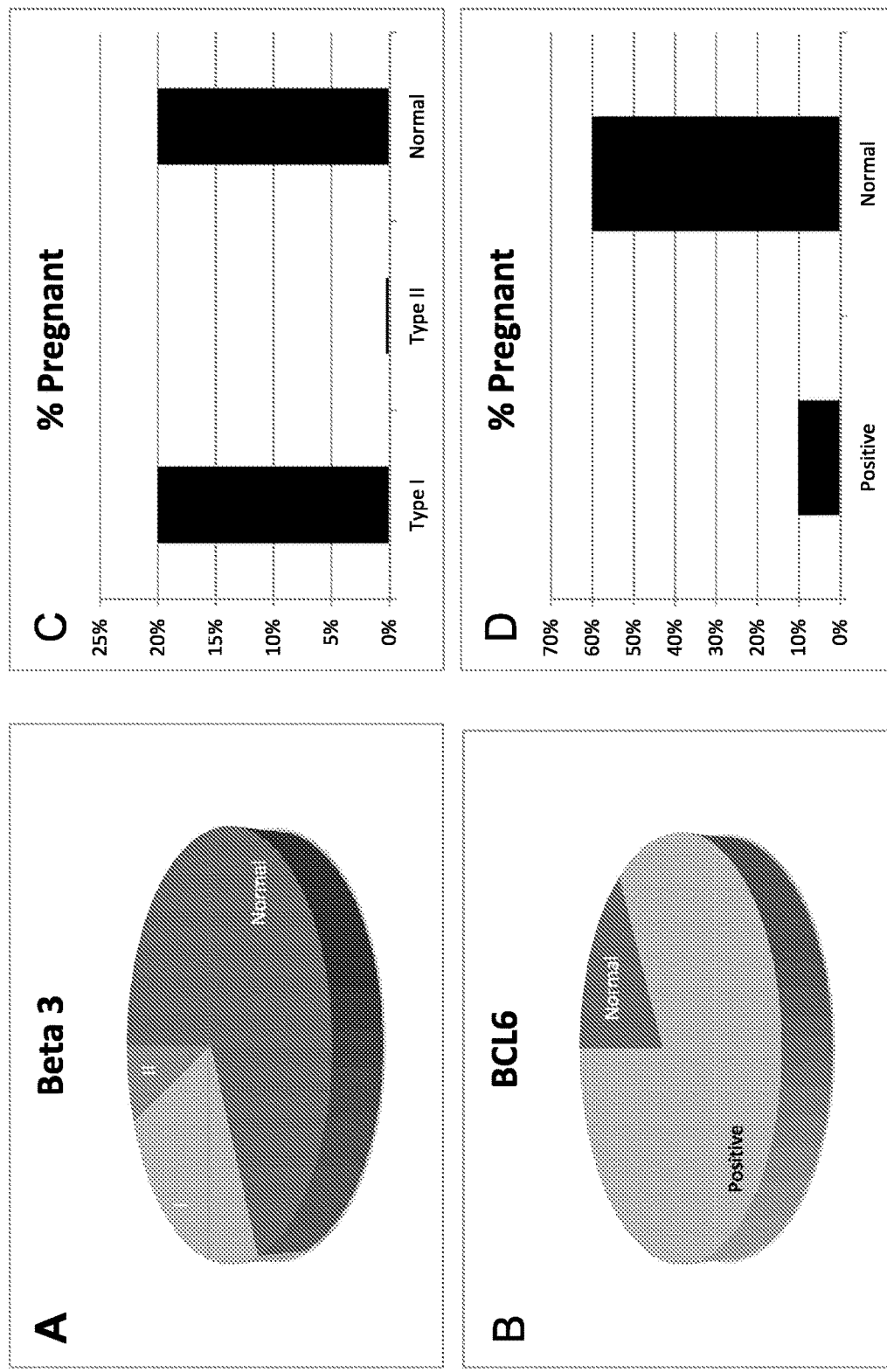
FIGS. 6A-6D depict the results of pregnancy rates of subjects undergoing. In Vitro Fertilization (IVF) or Frozen Embryo Transplantation (FET) with normal (Normal), Type I (I), and Type II (II) defects (defined herein below) based on beta3 expression and in normal (i.e., BCL6-negative; Normal) versus BCL6-positive subjects (i.e., BCL6 overexpressers; Positive).

In 59 cycles, patients exhibited the respective defects in Beta3 integrin and BCL6 as shown in FIGS. 6A and 6B. There was a small (10%) finding of Type II defects, which have been studied in the context of diagnosis for endometriosis (Lessey et al., 1994a) and for its impact on infertility (Franasiak et al., 2014) and in IVF cycles (Miller et al., 2012). In IVF cycles, the pregnancy rate in beta3 negative individuals that did not receive any treatment was severely compromised as compared to beta3 positive individuals (p<0.02), but the deficiency was overcome by treatment with the aromatase inhibitor Letrozole (4,4'-((1H-1,2,4-triazol-1-yl)methylene)dibenzonitrile; 2.5-5 mg/day on days 2-6). Closer review of the Miller et al., 2012 subjects revealed that none of the Type II subjects conceived (0%; see also FIG. 6C). In the remaining individuals, who had either Type I defects (integrins missing due to histological delay) or normal integrins, the success rates were similar (see FIG. 6C). In contrast, when BCL6 was positive, signifying a defect in endometrial receptivity, the percentage of women with a successful pregnancy was low (10.2%) compared to BCL6 positive subjects (60%; see FIG. 6D).

Summarily, the presently disclosed data demonstrated that when beta3 was missing and the subject's histology was in phase, there were profound defects in endometrial receptivity. However, many of the women with IVF failure tested positive (normal) or were missing beta3 integrin due to out of phase histology, and these results did not predict IVF outcomes.

Example 4

Figure 7:
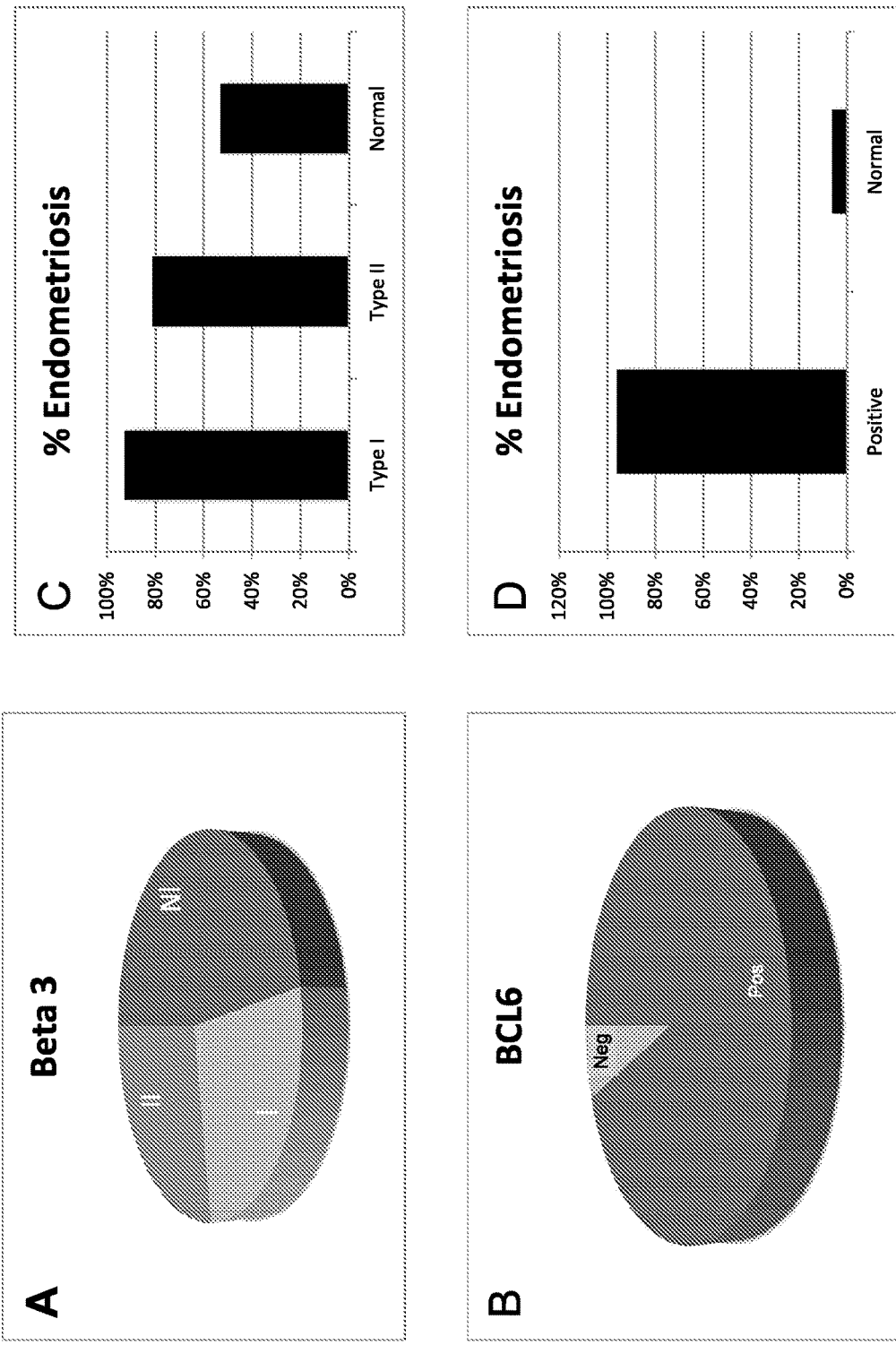
FIGS. 7A-7D depict the frequency of endometriosis in subjects with normal (NI), Type I (I), and Type II (II) defects (defined herein below) based on beta3 expression and in normal (i.e., BCL6-negative; Neg) versus BCL6-positive (i.e., BCL6 overexpressers; Pos) subjects. In unexplained subfertility patients, the prevalence of different types of defects based on beta3 is shown in FIG. 7A. In BCL6 stained slides, most of the subfertile women tested positive for BCL6 (i.e., overexpressed BCL6; see FIG. 7B). In subsequent analyses by laparoscopy, the prevalence of endometriosis was higher in Type I and II cases compared to normal beta3, but the predictive value, specificity, and sensitivity was much higher using BCL6 (see FIGS. 7C and 7D, respectively).

Beta3 and BCL6 Comparisons in Predicting the Presence of Endometriosis or Hydrosalpinges: Two Causes of Infertility To compare beta3 integrin results with BCL6, a prospectively obtained set of samples that were immunostained for the beta3 integrin and BCL6 was employed. Sixty-two patients with unexplained infertility were biopsied prior to surgery. A group of 28 fertile controls that were also prospectively recruited were used as controls. The types of defects observed in the infertile group for beta3 are shown in FIG. 7A. The majority of patients were normal, and the rest were out of phase (i.e., Type I) or in phase and missing integrin expression (i.e., Type II). Beta3 integrin expression differences were not able to distinguish between normal women and women with endometriosis (see FIG. 7C).

BCL6 expression was mostly positive in the infertile women (see FIG. 7B) and only positive in 2/28 (7%) of fertile controls. Unlike beta3 integrin, BCL6 staining was useful in defining the presence of endometriosis (96%) and normal women (see FIG. 7D). Based on these subjects and the relative staining results, the sensitivity and specificity and positive predictive and negative predictive values for beta3 and BCL6 were calculated (see Table 4). There were fewer cases stained for beta3, but the numbers demonstrated superior sensitivity, specificity, PPV, and NPV for BCL6 for prediction of endometriosis. These numbers were similar to what was determined for BCL6 in the initial test population.

TABLE 4

Summary of Characteristics of BCL6 and Beta3 Endometriosis Predictor Tests

| | True Positive | True Negative | False Positive | False Negative | Sens[a] (%) | Spec[b] (%) | PPV (%) | NPV (%) |
|---|---|---|---|---|---|---|---|---|
| beta3 | 16 | 26 | 3 | 41 | 28.1 | 89.7 | 84.2 | 38.8 |
| BCL6 | 59 | 26 | 4 | 4 | 93.7 | 86.7 | 93.7 | 86.7 |

[a]Sens: Sensitivity;
[b]Spec: Specificity

Example 5

Effects of Treatments on Pregnancy Rates

Patients with Type II defects, characterized by absent beta3 integrin despite normal in phase endometrium, have a poor prognosis with respect to successful pregnancy. Whether surgical or medical intervention could increase the pregnancy percentage in these subjects was tested. The results are presented in FIG. 12.

Figure 12:
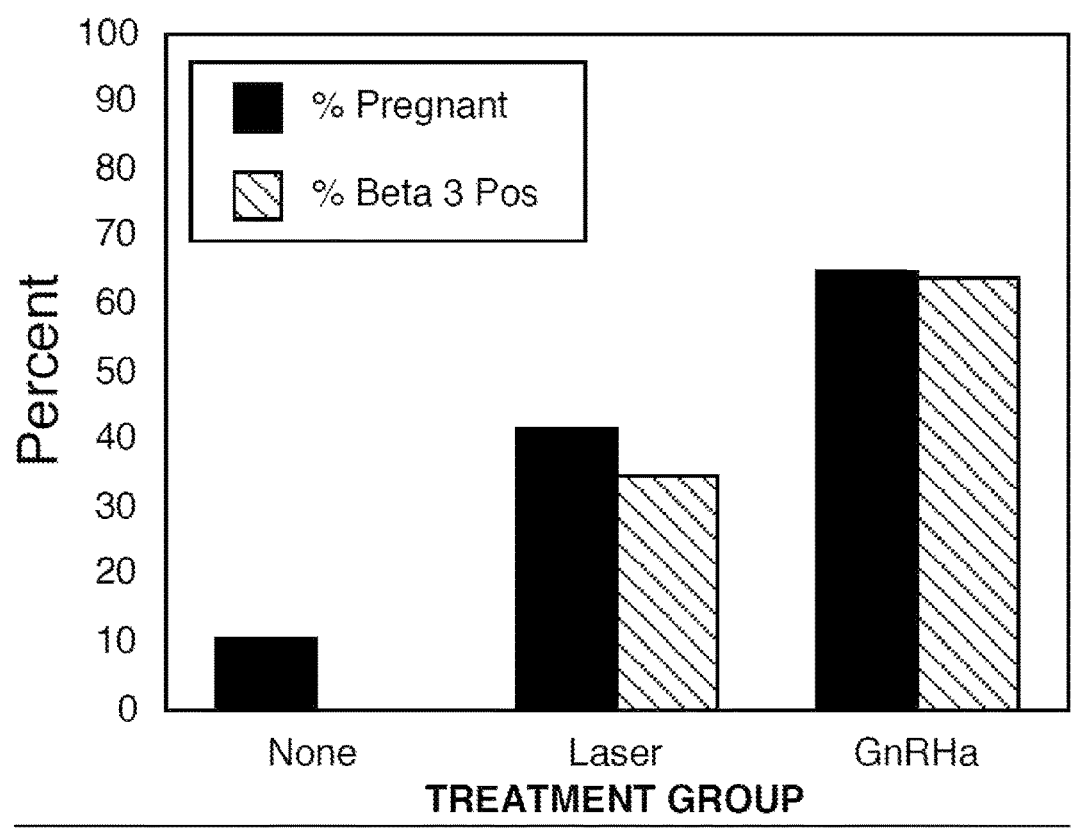
FIG. 12 is a bar graph showing the effect of treatment to reduce or eliminate endometriosis on pregnancy rates of Type II patients. Black bars correspond to percentages of patients who got pregnant, and hatched bars correspond to the percentage of patients who experienced a return of beta3. None: patients received no treatment; Laser: patients received surgical treatment (n=48); GnRHa: patients were treated with LUPRON® (n=26).

As shown in FIG. 12, if expectant management was used (None), only a 10% pregnancy rate over the next 6 months was observed. If subjects elected to have surgery (n =48), a 43% pregnancy rate was observed. Subjects who were administered the GnRH agonist LUPRON®) for 3 months exhibited a 68% pregnancy rate. When a subset of these subjects were rebiopsied and tested again for beta3 integrin, comparable percentages of the subjects had return of the integrin.

Figure 10:
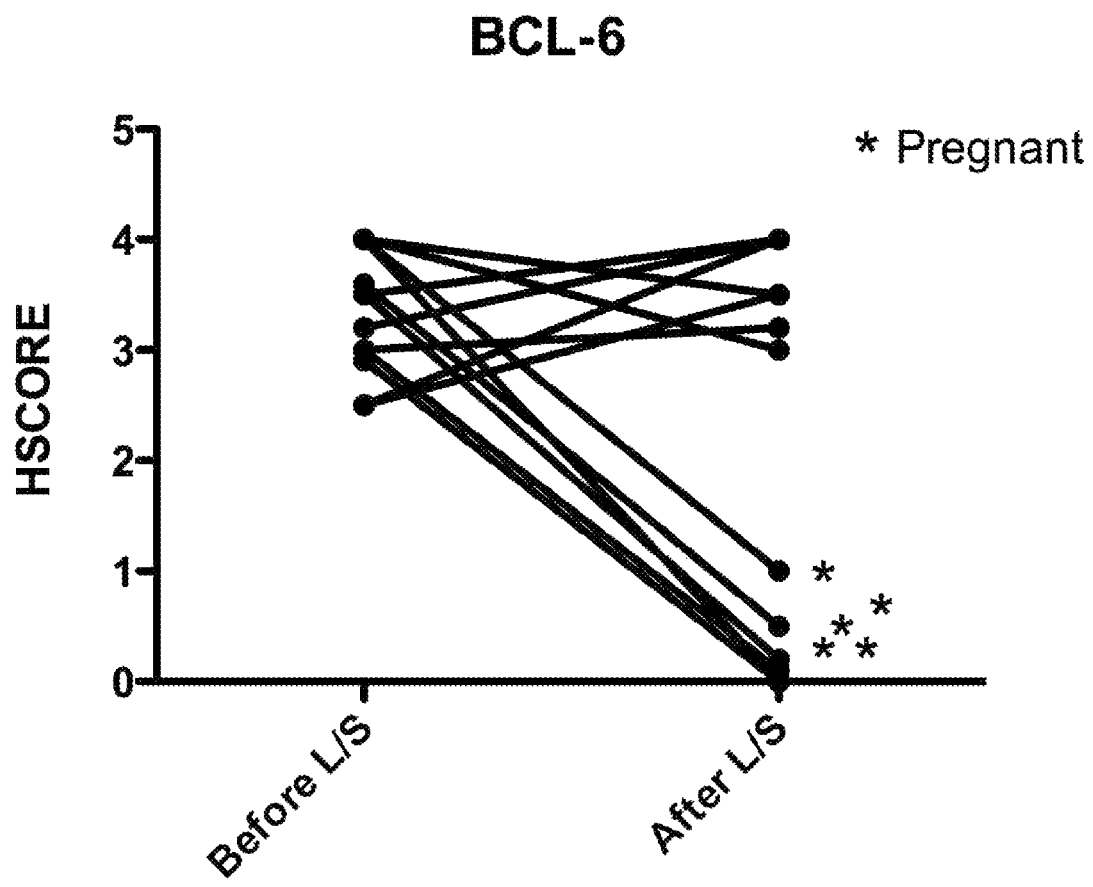
FIG. 10 is a plot showing HSCOREs for BCL6 expression in patients before and after laparoscopy (L/S). The asterisks indicate patients that became pregnant after their expression of endometrial BCL6 was reduced after laparoscopy.

Similar studies were performed for the BCL6. An initial BCL6 determination was done either just before surgery or in the cycle preceding laparoscopic surgery. A second BCL6 test was done in the cycle after surgery (i.e., after menses and in the next cycle). As shown in FIG. 10, most of those with reduction in BCL6 established a pregnancy, while none of the BCL6 positive (i.e., BCL6 overexpressing) patients conceived.

Figure 11:
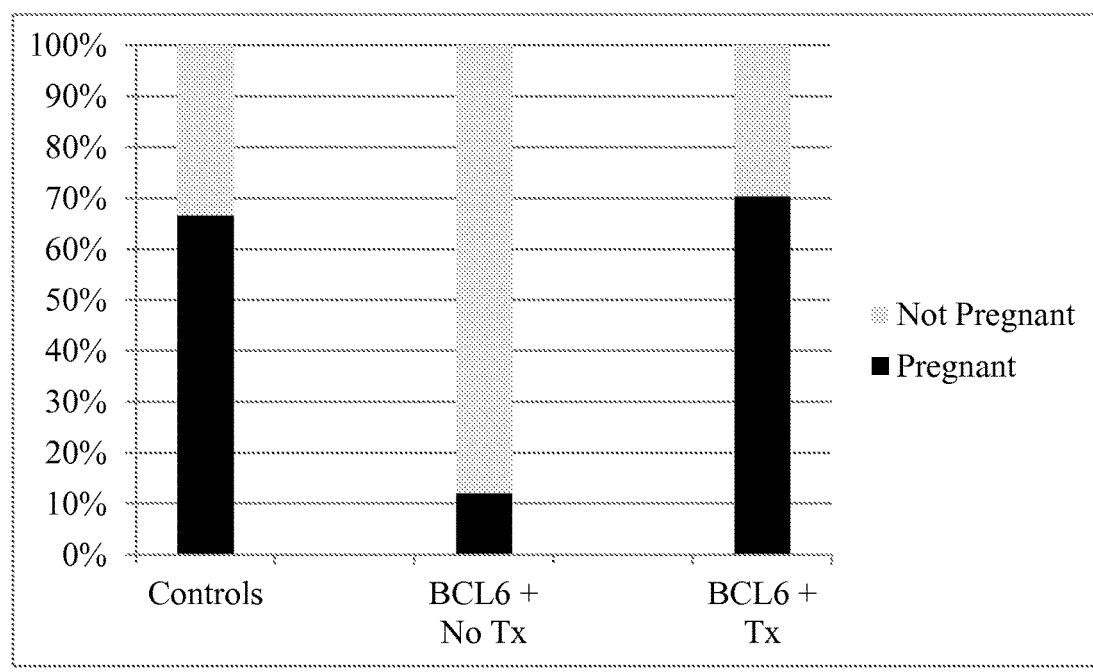
FIG. 11 is a bar graph showing the frequencies of pregnant and non-pregnant embryo recipients after in vitro fertilization (IVF) and frozen embryo transfer (FET) cycles in patients without endometriosis (Controls), patients who had endometriosis associated with BCL6 overexpression who did not receive any treatment (BCL6+No Tx), and patients who had endometriosis associated with BCL6 overexpression who received treatment for their endometriosis (BCL6+Tx). As shown in the Figure, 67% of patients without endometriosis (8/12) got pregnant, but only 10% of those with endometriosis who did not receive treatment got pregnant (5/44). Treatment for endometriosis increased the percentage of patients who got pregnant back up to 66.6% (16/24).

In IVF, when subjects were treated with LUPRON® before IVF or their endometriosis was surgically ablated, 19 out of 27 (70%) conceived with IVF compared to 10% (6 of 49) that underwent IVF without pre-treatment with LUPRON® or surgical resection (see FIG. 11). Since BCL6 positive tests were more common than Type II beta3 defects, the potential for benefit using BCL6 to direct a post-biopsy treatment strategy is thus much greater.

Discussion of the Examples

The interface between the two biomarkers BCL6 and the β3 integrin subunit (beta3) provides an enhanced ability to detect and react to defects in endometrial receptivity. This is especially important for high risk, high cost procedures such as in vitro fertilization (IVF). Over the past 10 years, the success rates for IVF have remained stagnant, with less than half of all women entering IVF cycles being successful (see IVF Data available on the FastStats Homepage of the United States Centers for Disease Control and Prevention website). Although meta-analyses have not found endometriosis to influence IVF rates (Barnhart et al., 2002), the United States Centers for Disease Control and Prevention (CDC) lists the prevalence of endometriosis at only 9% and most of the failures listed in the CDC website are of unknown causes.

Figure 8:
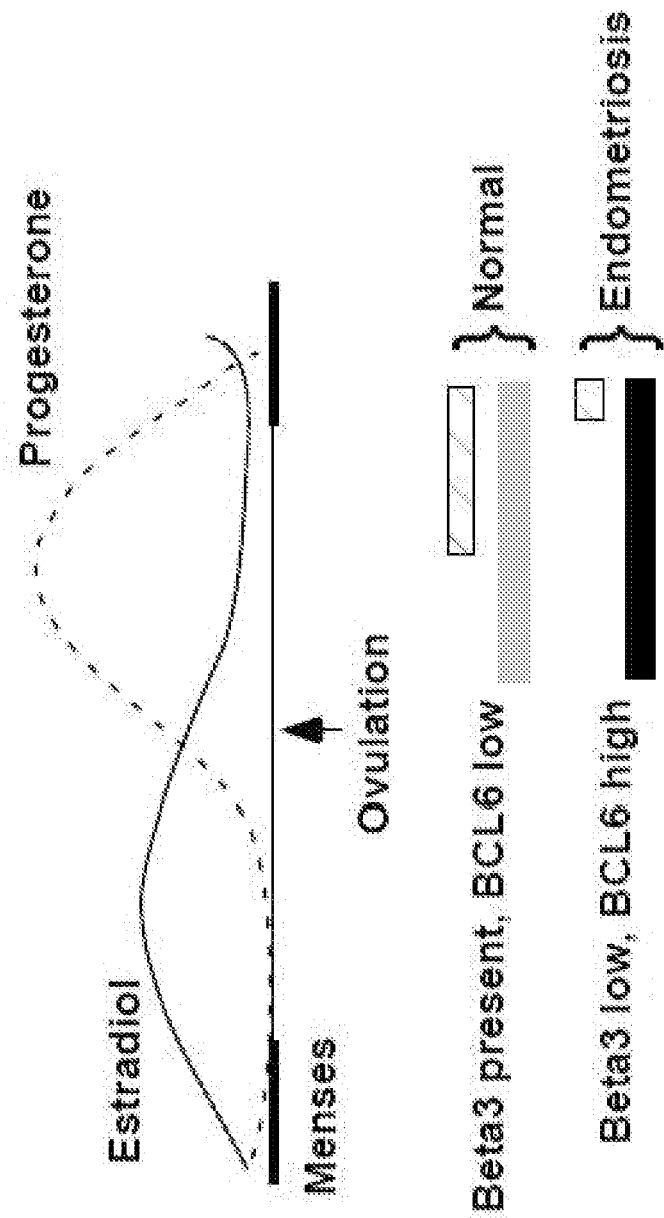
FIG. 8 depicts estradiol (solid line) and progesterone (dotted line) expression level changes during the menstrual cycle. Also shown are expression windows for beta3 integrin (Beta3; hatched boxes) and BCL6 (gray and black boxes). In normal endometrium, beta3 is expressed only after day 20, and BCL6 expression is very low (gray box). In contrast, beta3 expression is low or absent and BCL6 expression is elevated (black box) in endometriosis.

Beta3 expression status can be employed to predict IVF failure (Miller et al., 2012), but as disclosed herein, examination of BCL6 expression status improved the sensitivity of this test. The relationships between beta3 expression and BCL6 expression and presumed defects of endometrial receptivity are thus disclosed herein. As shown in FIG. 8, during a normal menstrual cycle, estrogen rises in the proliferative phase. With ovulation, progesterone begins to rise. Beta3 expression appears normally (hatched box) on cycle day 20 at the time of peak progesterone. BCL6 is usually expressed at low levels during the secretory phase (black box). In women with defects in endometrial receptivity (i.e., women with endometriosis), beta3 is delayed or missing while BCL6 is highly expressed (see second set of bars in FIG. 8).

Figure 9:
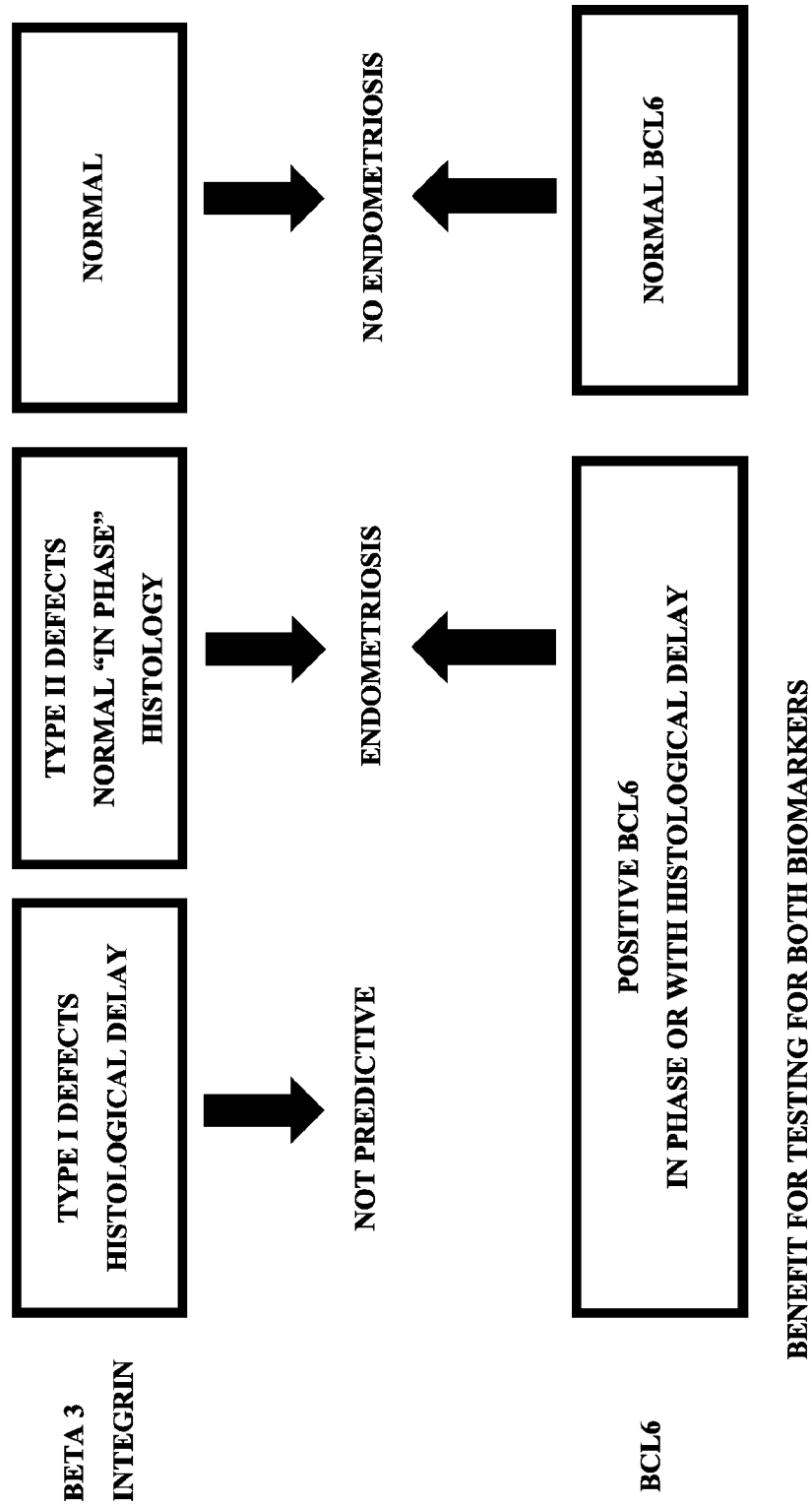
FIG. 9 is a chart showing how expression levels of beta3 and BCL6 function as predictors of endometriosis or no endometriosis. As set forth therein, since beta3 is uniformly absent before day 20 of the menstrual cycle, histological delay or early biopsy is not predictive. BCL6, on the other hand, is present throughout the secretory phase (progesterone dominant) of the menstrual cycle and high expression in out of phase endometrium is predictive of endometriosis when beta3 is absent. Normal BCL6 expression (i.e., low expression) and normal beta3 expression (i.e., high expression) predicts the absence of endometriosis and normal receptivity.

Beta3 expression was always missing in women with histological delay (see FIG. 9). Endometrial BCL6 was overexpressed in the presence of endometriosis. Thus, when the combination of beta3 and BCL6 were used together as biomarkers, the predictive value for detection of endometriosis was enhanced. A second deficiency of beta3 testing alone came when endometriosis was present and beta3 was also present (see FIG. 9). Again, the combination of normal BCL6 expression (i.e., at low levels) and normal beta3 expression (i.e., at high levels) predicted a normal endometrium, suggesting that there was no endometriosis present. If BCL6 was positive, even when beta3 was present, endometriosis was likely to be present. A summary of these relationships is shown in Table 5.

TABLE 5

Combined Beta3 and BCL6 Predictor Testing with Respect to Receptivity and Endometriosis

| Beta3 Abnormal | BCL6 Abnormal | Histology Out of Phase | Receptivity | Endometriosis Likelihood |
|---|---|---|---|---|
| No | No | No | Normal | Very low |
| No | Yes | No | Impaired | High |
| Yes | No | No | Very impaired | High |
| Yes | Yes | No | Absent | Very high |
| Yes | Yes | Yes | Impaired | Very high |
| Yes | No | Yes | Very impaired | High |

And finally, what has not been appreciated prior to the instant disclosure is that the level of expression of BCL6 is low in the endometrium of normal women but extremely high in the endometrium of women with inflammatory conditions such as endometriosis. This is of particular relevance because U.S. Pat. Nos. 7,871,778 and 8,247,174, both to Giudice, relate to progesterone-mediated genes as potential candidates to be used to detect progesterone resistance. As set forth herein, however, the instant disclosure appears to have identified a source of progesterone resistance. Particularly, disclosed herein is the observation that even in the face of progesterone resistance, BCL6 expression is higher than expected, meaning that it is regulated by more than just progesterone.

Also disclosed herein are experiments that demonstrate that surgical and/or medical treatments for abnormal beta3 and BCL6 statuses can result in changes in expression of these biomarkers. For example, in at least some subjects, BCL6 staining returned to normal after surgical treatment, suggesting that this biomarker responded to charges in disease status. Furthermore, those subjects who did experience normalization of BCL6 expression were much more likely to conceive than those who retained abnormal BCL6 expression, suggesting a tight relationship between BCL6 and functional status. And finally, the fact that BCL6 expression changed in response to therapy suggests that it can be used as marker of disease presence and recurrence as well as to identify patients that need therapies other than surgery.

REFERENCES

All references listed throughout herein above and immediately herein below, including but not limited to all patents, patent applications and publications thereof, scientific journal articles, and database entries (including but not limited to GENBANK® biosequence database entries and all annotations available therein) are incorporated herein by reference in their entireties to the extent not inconsistent herewith and to the extent that they supplement, explain, provide a background for, or teach methodology, techniques, and/or compositions employed herein.

Adamson et al. (2010) Creating solutions in endometriosis: global collaboration through the World Endometriosis Research Foundation. J Endometriosis 2:3-6.

Aghajanova et al. (2010) Altered gene expression profiling in endometrium: evidence for progesterone resistance. Semin Reprod Med 28:51-58.

Arici et al. (1996) The effect of endometriosis on implantation: results from the Yale University in vitro fertilization and embryo transfer program. Fertil Steril 65:603-607.

Barnhart et al. (2002) Effect of endometriosis on in vitro fertilization. Fertil Steril 77:1148-1155.

Bird et al. (1988) Single-chain antigen-binding proteins. Science 242:423-426.

Budwit-Novotny et al. (1986) Immunohistochemical analyses of estrogen receptor in endometrial adenocarcinoma using a monoclonal antibody. Cancer Res 46:5419-5425.

Burney et al. (2009) MicroRNA expression profiling of eutopic secretory endometrium in women with versus without endometriosis. Mol Hum Reprod 15:625-631.

Chaouat et al. (2007) Cytokines: Important for implantation? J Assist Reprod Genet 24:491-505.

Coligan (1991) Current Protocols in Immunology, John Wiley & Sons, New York, N.Y., United States of America.

Creus et al. (2002) αvβ3 integrin expression and pinopod formation in normal and out-of-phase endometria of fertile and infertile women. Hum Reprod 17:2279-2286.

Franasiak et al. (2014) Prospective assessment of midsecretory endometrial leukemia inhibitor factor expression versus αvβ3 testing in women with unexplained infertility. Fertil Steril 101:1724-1731.

Giudice (2010) Clinical Practice. Endometriosis. N Engl J Med 362:2389-2398.

Hahn et al. (1986) Experimental evidence for failure to implant as a mechanism of infertility associated with endometriosis. Am J Obstet Gynecol 155:1109-1113.

Harlow & Lane (1988) Antibodies: A Laboratory Manual, Cold Spring Harbor Laboratory Press, Cold Spring Harbor, N.Y., United States of America.

Holoch & Lessey (2010) Endometriosis and Infertility. *Clin Obstet Gynecol* 53:429-438.

Hood et al. (1984) *Immunology, 2nd ed.* The Benjamin/Cummings Publishing Co., Menlo Park, Calif., United States of America.

Hunkapiller & Hood (1986) The growing immunoglobulin gene superfamily. *Nature* 323:15-16.

Huston et al. (1988) Protein engineering of antibody binding sites: recovery of specific activity in an anti-digoxin single-chain Fv analogue produced in *Escherichia coli. Proc Natl Acad Sci USA* 85:5879-5883.

Irwin et al. (1994) Growth factors and decidualization in vitro. *Ann N Y Acad Sci* 734:7-18.

Kojima et al. (2001) Testicular germ cell apoptosis in Bcl6-deficient mice. *Development* 128:57-65.

Kumagai et al. (1999) The proto-oncogene Bcl6 inhibits apoptotic cell death in differentiation-induced mouse myogenic cells. *Oncogene* 18:467-475.

Lanzavecchia et al. (1987) The use of hybrid hybridomas to target human cytotoxic T lymphocytes. *Eur J Immunol* 17:105-111.

Large & Demayo (2012) The regulation of embryo implantation and endometrial decidualization by progesterone receptor signaling. *Mol Cell Endocrinol* 358:155-165.

Lessey & Young (2014) Homeostasis imbalance in the endometrium of women with implantation defects: the role of estrogen and progesterone. *Semin Reprod Med* 32:365-375.

Lessey et al. (1992) Integrin adhesion molecules in the human endometrium. Correlation with the normal and abnormal menstrual cycle. *J Clin Invest* 90:188-195.

Lessey et al. (1994a) Aberrant integrin expression in the endometrium of women with endometriosis. *J Clin Endocrinol Metabol* 79:643-649.

Lessey et al. (1994b) Further characterization of endometrial integrins during the menstrual cycle and in pregnancy. *Fertil Steril* 62:497-506.

Lessey et al. (1995) Integrins as markers of uterine receptivity in women with primary unexplained infertility. *Fertil Steril* 63:535-542.

Lessey et al. (2013) Eutopic endometrium in women with endometriosis: ground zero for the study of implantation defects. *Semin Reprod Med* 31:109-124.

Meyer et al. (1997) Hydrosalpinges adversely affect markers of endometrial receptivity. *Hum Reprod* 12:1393-1398.

Miller et al. (2012) Endometrial receptivity defects during IVF cycles with and without letrozole. *Hum Reprod* 27:881-888.

Navot et al. (1991) An insight into early reproductive processes through the in vivo model of ovum donation. *J Clin Endocrinol Metab* 72:408-414

Noyes et al. (1950) Dating the endometrial biopsy. *Fertil Steril* 1:3-25.

Olive & Schwartz (1993) Endometriosis. *N Engl J Med* 328:1759-1769.

Plante et al. (2012) G protein-coupled estrogen receptor (GPER) expression in normal and abnormal endometrium. *Reprod Sci* 19:684-693.

Popovici et al. (2000) Discovery of new inducible genes in in vitro decidualized human endometrial stromal cells using microarray technology. *Endocrinology* 141:3510-3513.

Ryan et al. (1994) Isolation, characterization, and comparison of human endometrial and endometriosis cells in vitro. *J Clin Endocrinol Metab* 78:642-649.

Shaffer et al. (2000) BCL6 represses genes that function in lymphocyte differentiation, inflammation, and cell cycle control. *Immunity* 13:199-212.

Simón et al. (1994) Outcome of patients with endometriosis in assisted reproduction: results from in-vitro fertilization and oocyte donation. *Hum Reprod* 9:725-729.

Strathy et al. (1982) Endometriosis and infertility: a laparoscopic study of endometriosis among fertile and infertile women. *Fertil Steril* 38:667-672.

Takeda et al. (2003) Bcl6 is a transcriptional repressor for the IL-18 gene. *J Immunol* 171:426-431.

Talbi et al. (2006) Molecular phenotyping of human endometrium distinguishes menstrual cycle phases and underlying biological processes in normo-ovulatory women. *Endocrinol* 147:1097-1121.

Tiberi et al. (2014) A BCL6/BCOR/SIRT1 Complex Triggers Neurogenesis and Suppresses Medulloblastoma by Repressing Sonic Hedgehog Signaling. *Cancer Cell* 26:797-812.

U.S. Pat. Nos. 4,981,785; 5,358,691; 5,599,677; 5,672,480; 5,885,530; 6,159,750; 7,871,778; 8,247,174.

Verkauf (1987) Incidence, symptoms, and signs of endometriosis in fertile and infertile women. *J Fla Med Assoc* 74:671-675.

Wei et al. (2010) Indian Hedgehog and its targets in human endometrium: menstrual cycle expression and response to CDB-2914. *J Clin Endocrinol Metab* 95:5330-5337.

Yu et al. (2005) BCL6 negatively regulates macrophage proliferation by suppressing autocrine IL-6 production. *Blood* 105:1777-1784.

It will be understood that various details of the presently disclosed subject matter may be changed without departing from the scope of the presently disclosed subject matter. Furthermore, the foregoing description is for the purpose of illustration only, and not for the purpose of limitation.

SEQUENCE LISTING (116 sequences)

SEQ ID NO: 1 - DNA, 3575 bp, Homo sapiens
  CDS (366)..(2486)
accatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaaa

SEQ ID NO: 2 - protein, 706 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 3 - DNA, 3662 bp, Homo sapiens
  CDS (458)..(2578)
gcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaa

SEQ ID NO: 4 - protein, 706 aa, Homo sapiens; identical to SEQ ID NO: 2

SEQ ID NO: 5 - DNA, 3086 bp, Homo sapiens
  CDS (50)..(2002)
gttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaa

SEQ ID NO: 6 - protein, 650 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 7 - DNA, 3562 bp, Pan paniscus
  CDS (366)..(2486)
accatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttatcaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaactaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccatactggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacagtgttcatcccatgatgtagtgcctctttcatccactagtgcaaatcatagctgggggtggggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 8 - protein, 706 aa, Pan paniscus
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETVPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 9 - DNA, 6297 bp, Pan paniscus
  CDS (3101)..(5221)
gagttagtgacttaaccaggaccagattttaagcttctgaatttcatgtcagtgactgaaagtcaaaggcgggtttatctcagctcctttgaagtatttatgagaaaggagcggctgccagaaccatgagtttaacctcttaggccacctttgttgccagtgttcattggaaaccgctccccagcagtcttggaggattcttttttaaagaaaatatggcctaagattttcggtaatgacacgaaaagcccagatggtgctgaagggtgtgggtctcggagctcgggggtttgcgtgttaagaggggggttaaggcctggaccaaagacttgcagggcgagcctcgattctgaaatcgctctcttccccttcctaacatcctctgcatagtagcctggcgagaaaccgggtgtgtgtgtgtgagggggtgggggtcatgtggataggccagaatttgtgccacaacagttcctccgtaaagttttctttctccgagctcgtgacttaagatggcaaacgcgcgtccgcatgctggcggcccctagcggcagcaggcgcgctctgcagggggagacagcgccgtctcccccgcccgggtcggcggggatcgagttcggcctctcccactgcgggagccgtcggaggccgcgtcggagaaacgcgcctctgttcggactggaaacgaatctgggaacgagtttgaagcgcggtcaagtttgactcatcgccttccaaggacagttagtgccttccatcttcattaacgtgaataaggaccttggctgacttctttccagatcggatttttaaaggcattgtttgcttgaggagatcatgcttctcccctcccccgccagcctttttgcaaaggctgagcccagtccagccaggacggccgagggatctctgctccgggacgcgatttgctggcattgtcttcgggcccttctggaaggctgtctcgcgctgagcgtatggggaacgtcccttctgcaactcctcttcagatcttgaagataaaacacatccctctgttttattgcatttcctagaagcttgcaggcttgcaagagcactgttggcaggaaacgtgatagaaatgaaagtcaggacacaatgtccccgaacacctcggttatccaaagcggctgccgaggccatcgcgttatcaaattcgcttttatttactgtcgtctcctgcgccctcccgttccccagccaagagggcgaagagtgttttcccccaagaataaaaacagctccgcgatttgacctcgccccctgccgccggaccacggtggtgtctgcagccgtgcagctagttggctgaaacactgctgagaccgggagccccacggcagggcccctgatgcggggttcactacggcagttccagccttattaaaattccttgtccttgtccctaaacagtgctttacactttcagatttccctttggatttttcagcgggttattggagttattagattaccaataatccaacagcctctgtagcctctctggctggagaggaggggggaagggcggaaggcattctccaaatcgggaggctctggccaaactgggtcaatgggaaggaggggaggggcgagaaaggggttgacagtttcaaaccttgatggagggctctctctagcgttaggcagcggtaaaaacaccattcggtttgagctcccggaaccacgggactcctaatttccaataaaggcacttacttcattttaacttcccagattctcatccctaccccttattaaatcccaaccgtctctttcacctttatcccaccgggcgaagaggtgagaaagcctcaatgtaggattttgaggccaaaggctccgtctttgcagaccgactctgacccttccgcttgccgcagaagggatgagcggcgcagtgtgacgccactggctagttttaggaccagactgcggcctttgtggctgagtctttcgctgtcccctagcccccgaaagcgcaccccggagcctgctaccgagaccaattaggacatggcacccggggattataattcccgggagggccacaggaaggcgaggcaactttggagagtgccagtgcgcgcgcaggggtcggggtcccggcctttgccgagtccaagctgtgtctctacggtttcggggaaatcggattcggaaatccttacggcttggcagctcctattctaaagactttgggcggaaaccaagtggagctgggttcccgttcttgccaacgtaggcggaaggggctttctgtttagtttttctccaaccttgcctggggcgcctatgatggagaccctcagcccctagggactccatcttttgaccttgaagtctcgctcaaacattcccctaaaagaacggggatgagggagaatggaaggcaaaaagagggaaaaaagcaaataaacctcggaatcggacaacttaaagtctcgatatgagcctcggattgtattcgaactcctgggttctagacccagctctgctactaacttgtctgaccttccccatttataaactgttgtggatgagaggctggactaggtgaactcagagccctgcactcggcgcggacgagggatttaggggaaagtgtgctgtattccccgcgagccttccccagcggccccgcctccccgggtgaatccccggcggccagcgcagcgcaggcagcgatcctggcggctgccggggcccggcagcttcctggaaagttacttcttgttggagccggcgataggcaaagtgtgttctgtgaaatccgcagagccgagattgactacgttccgggaatgagagggctgtgtcattcccctcattgcctgctgccttgacggcgtaacaggaaaaaaaaaaaaaaaaaaggacatacacacaatgttagctaccgaggtgcacgaaaagttttatttgaatgtaactaaattaagggccgccacggtcataccacaaagcctccgtcgcgccttgcggggggcttcgaggcggatcgcccaggggcgggcagtccctggaagacaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttatcaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaactaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccatactggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacagtgttcatcccatgatgtagtgcctctttcatccactagtgcaaatcatagctgggggtggggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 10 - protein, 706 aa, Pan paniscus; identical to SEQ ID NO: 8

SEQ ID NO: 11 - DNA, 4530 bp, Pan paniscus
  CDS (1334)..(3454)
ccgaagctcaaattccgagaattgagctctgttgattcttagaactggggttcttagaagtggtgatgcaagaagtttctaggaaaggccggacaccagctcttttaaaggatctgtcttctcaaggagcctagttggctatgcacaaggaaagcgccaaaagagctaaagggaggaagggaagagaaaacatttaactctcccatggtggttactgacccagcgtgggtgcggggagattgggatgggaagtccaggtctgggggcagccagcagttgtcagtttctcattgacagccctgctccttggagattgtttttgtgggtagtcttgtgtgtggcattggtggaatggctgaatctaggagacgcggcgtgtccagaacttgctggaaattggttttgagattttgggcaaggcctctcacccggagcctcagttccctccctaataaagcagggctgttataaggataagatgcaatcgtgagggggtgggaaaggactaagagctctgtaaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggtccagctgacagtggacacaggggaatttgtttgtttgtttcaatccgcatctggagtgagtcattgccacttgtcatagtgaaatggcaaatctgggcttcctgtggttccagaagcctgcgactggaaatccacaagcgagctggtggttgaagatggttaaagaacagcctaggtattccagaagtgtttgaggatcccttccatgaaagaagagaggaaagtttataagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttatcaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaactaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccatactggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacagtgttcatcccatgatgtagtgcctctttcatccactagtgcaaatcatagctgggggtggggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 12 - protein, 706 aa, Pan paniscus; identical to SEQ ID NO: 8

SEQ ID NO: 13 - DNA, 3851 bp, Pan troglodytes
  CDS (653)..(2773)
  misc_feature (2943)..(2944): n is a, c, g, or t
  misc_feature (2946)..(2950): n is a, c, g, or t
  misc_feature (2952)..(2952): n is a, c, g, or t
  misc_feature (2954)..(2954): n is a, c, g, or t
  misc_feature (2956)..(2958): n is a, c, g, or t
atttttttttttctcttactcgcctctctaaccctactatatatataacatactttccccagtggttcaaacctctcgctcccttttgtgcatttagctcgatctgctgagtttatgggtaagaaagaaggaattagccccagaccccgggaaagcaaagcgcactccccctcttatgtcaccgaatagcaaattagttctcagaattccagaggccgagctttgctacagcgaaggcgccgacgtcacagaggaggagcccacgtgacggtggcggagcaggccataccatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttattaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggactgggagnngnnnnngntncnnntcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 14 - protein, 706 aa, Pan troglodytes; identical to SEQ ID NO: 8

SEQ ID NO: 15 - DNA, 3250 bp, Pan troglodytes
  CDS (52)..(2172)
  misc_feature (2342)..(2343): n is a, c, g, or t
  misc_feature (2345)..(2349): n is a, c, g, or t
  misc_feature (2351)..(2351): n is a, c, g, or t
  misc_feature (2353)..(2353): n is a, c, g, or t
  misc_feature (2355)..(2357): n is a, c, g, or t
aggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttattaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggactgggagnngnnnnngntncnnntcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 16 - protein, 706 aa, Pan troglodytes; identical to SEQ ID NO: 8

SEQ ID NO: 17 - DNA, 4495 bp, Pan troglodytes
  CDS (1297)..(3417)
  misc_feature (3587)..(3588): n is a, c, g, or t
  misc_feature (3590)..(3594): n is a, c, g, or t
  misc_feature (3596)..(3596): n is a, c, g, or t
  misc_feature (3598)..(3598): n is a, c, g, or t
  misc_feature (3600)..(3602): n is a, c, g, or t
ctctctctctttgcttttttttttttttttttttggttcctgttttcttcttcaatggaaagctcttttaaaggatctgtcttctcaaggagcctagttggctatgcacaaggaaagcgccaaaagagctaaagggaggaagggaagagaaaacatttaactctcccatggtggttactgacccagcgtgggtgcggggagattgggatgggaagtccaggtctgggggcagccagcagttgtcagtttctcattgacagccctgctccttggagattgtttttgtgggtagtcttgtgtgtggcattggtggaatggctgaatctaggagacgcggcatgtccagaacttgctggaaattggttttgagattttgggcaaggcctctcacccggagcctcagttccctccctaataaagcagggctgttataaggataagatgcaatcgtgagggggtgggaaaggactaagagctctgtaaaaatacaaaccaaatgctggtggtgcttccacacctgcggcatttggggtgggggtggtgacaacattgcccacactcaacccacacactgaggagttggggggagctggttcttaagacgagttggcttgcaaaggagtgaacttgagaaggacctgcgcctcgtgtatgtacatttgtttttggccaggcagaggcttacggtgaaaagcccaaggtccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagatggttaaagaacagcctaggtattccagaagtgtttgaggatcccttccatgaaagaagagaggaaagtttataagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttattaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggactgggagnngnnnnngntncnnntcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 18 - protein, 706 aa, Pan troglodytes; identical to SEQ ID NO: 8

SEQ ID NO: 19 - DNA, 3711 bp, Chlorocebus sabaeus
  CDS (512)..(2632)
tcgtggaatcattctaagacttgaaagataatattgtagcaggttttgaatgacgtccagtatatttaggtcacagacggatcattattgttaatgttgacagaaccatttttcttgttttttatttcccataaactcaagtggcctttggatggtatatattttttctttgaagaaggaaatgtatgtatgtatgtatgtatgtatgtataactaattaatgtatgcaattgtactcccagtactcaggataaaaacattattatctcatagctttgggtgcctgttgttttcgtaagagcagagctggaaaatgtttgttagcttgtggtaaaaccacaccagctggcaagctgcaactatcaaagcaaaactaaatgtgtgtgtcctaaaataagactatagtggacaatcttacattcgttaaatcaatttctgtttgctttcttctcttctctgcaggttttgagcaaaattttggactgtgaagcaaggcattggtgaagacaaaatggcctcgccggctgacagctgcatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatcttcacagaccagttgaaatgcaaccttagtgtgatcaatctagatcctgagatcaaccctgagggcttctgcatcctcctggactttatgtacacatctcggctcaatttgcgggagggcaacatcatggctgtgatggccacagctatgtacttgcagatggagcatgttgtggacacctgccggaagtttatcaaggccagtgaagcagagatggttcctgccatcaagccccgtcacgaagagttcctcaacagccgcatgctgatgcctcaagacatcatggcctatcggggtcgtgaggtggtggagaacaacctgccactgaggaacgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggccctgccgtgcgatagtaccaggccagtccccggtgagtacagccggccggccttggaggtgtcccccagtgtgtgccacagcaatatctattcacccaaggaaacagtcccagaagaggcacgaagcgatatgcactacagtgtggctgagggcctcaagcctgctgccccctcagcccgaaatgccccctacttcccctgtgacaaggccagcaaagaagaagagagaccctcctcagaagatgagattgccctgcatttcgagccccccaatgcacccctgaaccggaagggtctggttagtccacagagcccccagaaatctgactgccagcccaactcgcccacagaatcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaggggccagagcaggctgagctgggccgcctttccccacgagcctacactgccccacctgcctgccagccacctatggagcctgagaaccttgacctccagtccccaaccaagctcagtgccagcggggaggactccaccatcccgcaagccagccggctcaataacatcgttaacaggtccctgacaggctctccccgcagcagcagtgagagccactcaccactctacatgcaccccccgaagtgcacgtcctgcggctctcagtccccacagcatgcagagatgtgcctccacaccgccggccccacgttccctgaggagatgggagagacccagtctgagtactcagattccagctgtgagaacggggccttcttctgcaatgagtgtgactgccgcttctctgaggaggcctcactcaagaggcacacgctgcagacccacagtgacaaaccctacaagtgtgatcgctgccaggcctccttccgctacaagggcaacctcgccagccacaagaccgtccatacgggtgagaaaccgtatcgctgcaacatctgtggggcccagttcaaccgaccagccaacctgaaaacccacactcgaatccactctggagagaagccctacaaatgcgaaacctgtggagccagatttgtacaggtggcgcacctccgtgcccacgtgctcatccacactggtgagaagccctatccctgtgaaatctgtggcacccgtttccggcaccttcagactctgaagagccatctgcgaatccacacgggagagaaaccttaccattgtgagaagtgtaacctgcatttccgtcacaaaagccagctgcgacttcacttgcgccagaagcatggtgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggacggggagccgcagcagctccccctcccccactgccataaaacattaagaaaatcatattgcttcttctcctatgtgtaaggtgaaccacgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgtcaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaacaaaaagaacaaaaaaatctgcagaaggaaaaacgtgtaattttgttctagttttcagtttgtatataccggtacaacgtgtcctcacggtgccttttttcacggaagtgttcaatgacgggcgagcgtgtgccatcccgttttgaagtgtaggcagacacagggacttgaagttgttactaactaaactctctttgggaatgtgtgtctcatcccattctgcgtcatgcttgtgttgttactactccggagacagggtttggctgtgtctaaactgcatcaccgcgttgtaaaatatagctgtacaaatatcagaataaaatgctgaaaagtcaa

SEQ ID NO: 20 - protein, 706 aa, Chlorocebus sabaeus
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPRHEEFLNSRMLMPQDIMAYRGREVVENNLPLRNAPGCESRAFAPSLYSGLSTPPASYSMYSHLPVSSLLFSDEEFRDVRMPVANPFPKERALPCDSTRPVPGEYSRPALEVSPSVCHSNIYSPKETVPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSLTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 21 - DNA, 3560 bp, Chlorocebus sabaeus
  CDS (361)..(2481)
cgtcatgggtccggggagggagagccacattcaggcccctcgaacctcgaacgggaacctccaaatccgagacattctccttatgaggccctcgaaatatgccggacagtgaaaaactcttgtggctttgagggcttttgatcggccaggggaggtaaaaagctcagagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgcatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatcttcacagaccagttgaaatgcaaccttagtgtgatcaatctagatcctgagatcaaccctgagggcttctgcatcctcctggactttatgtacacatctcggctcaatttgcgggagggcaacatcatggctgtgatggccacagctatgtacttgcagatggagcatgttgtggacacctgccggaagtttatcaaggccagtgaagcagagatggttcctgccatcaagccccgtcacgaagagttcctcaacagccgcatgctgatgcctcaagacatcatggcctatcggggtcgtgaggtggtggagaacaacctgccactgaggaacgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggccctgccgtgcgatagtaccaggccagtccccggtgagtacagccggccggccttggaggtgtcccccagtgtgtgccacagcaatatctattcacccaaggaaacagtcccagaagaggcacgaagcgatatgcactacagtgtggctgagggcctcaagcctgctgccccctcagcccgaaatgccccctacttcccctgtgacaaggccagcaaagaagaagagagaccctcctcagaagatgagattgccctgcatttcgagccccccaatgcacccctgaaccggaagggtctggttagtccacagagcccccagaaatctgactgccagcccaactcgcccacagaatcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaggggccagagcaggctgagctgggccgcctttccccacgagcctacactgccccacctgcctgccagccacctatggagcctgagaaccttgacctccagtccccaaccaagctcagtgccagcggggaggactccaccatcccgcaagccagccggctcaataacatcgttaacaggtccctgacaggctctccccgcagcagcagtgagagccactcaccactctacatgcaccccccgaagtgcacgtcctgcggctctcagtccccacagcatgcagagatgtgcctccacaccgccggccccacgttccctgaggagatgggagagacccagtctgagtactcagattccagctgtgagaacggggccttcttctgcaatgagtgtgactgccgcttctctgaggaggcctcactcaagaggcacacgctgcagacccacagtgacaaaccctacaagtgtgatcgctgccaggcctccttccgctacaagggcaacctcgccagccacaagaccgtccatacgggtgagaaaccgtatcgctgcaacatctgtggggcccagttcaaccgaccagccaacctgaaaacccacactcgaatccactctggagagaagccctacaaatgcgaaacctgtggagccagatttgtacaggtggcgcacctccgtgcccacgtgctcatccacactggtgagaagccctatccctgtgaaatctgtggcacccgtttccggcaccttcagactctgaagagccatctgcgaatccacacgggagagaaaccttaccattgtgagaagtgtaacctgcatttccgtcacaaaagccagctgcgacttcacttgcgccagaagcatggtgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggacggggagccgcagcagctccccctcccccactgccataaaacattaagaaaatcatattgcttcttctcctatgtgtaaggtgaaccacgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgtcaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaacaaaaagaacaaaaaaatctgcagaaggaaaaacgtgtaattttgttctagttttcagtttgtatataccggtacaacgtgtcctcacggtgccttttttcacggaagtgttcaatgacgggcgagcgtgtgccatcccgttttgaagtgtaggcagacacagggacttgaagttgttactaactaaactctctttgggaatgtgtgtctcatcccattctgcgtcatgcttgtgttgttactactccggagacagggtttggctgtgtctaaactgcatcaccgcgttgtaaaatatagctgtacaaatatcagaataaaatgctgaaaagtcaa

SEQ ID NO: 22 - protein, 706 aa, Chlorocebus sabaeus; identical to SEQ ID NO: 20

SEQ ID NO: 23 - DNA, 9481 bp, Chlorocebus sabaeus
  CDS (6282)..(8402)
aggggggggcgggcagcaagagctaggggccaccccgctgccggatgtagtgaccgtggtaaatgtcttgagaactgtgggttgcgttgcctttatgatgccgtgttattggaaccctggcgaaaaaatggaactagtgttgtaataatgagttttaaagctgccccatggaaaacaaaaacacaaccaaaccgattttttaaaaaaatgaaaaaagaccctctgtgttgtgttcccttctacgatggttgagttggtggctggggtttgggggtggggggtcctgacagttgagccgataaatgaccccaaaccaggtgctgaaagtcccaagctgttacagggcccctgaccacctcaaagagccaatctccactccaccgccccccgcccccgccaccccacaacccgccaggatttaatcttttatggatttttttttcaatcagtttatagtttccaggaggaaagtcttgtaacgctttactttttctcttctttttttaaagtaaagtgagtgtcagtagatgtgttttttacagtctggattaaaaaaaagtggggcaggagagagggaaccagggaaagggctgtttagaaatacagtttgtggctctgagcgatgccaccggcttcctctacagagactgccagtttccctttttctttgcaaggtgtgtgtggttttaataaataactttaaaaaaaagagggggcggcaagatccatcaggagacaggtatctattttgctcactatttactaccaagagcctttggcactagaacagaacctcgtaaatctgcagcccaagttgaagttcatctggccctagtccacacgctattcctggaggtagcaaacatgagctcaaaggagagagatgaaatcacattcttgctttaaaatacatacttttttaaaaaagacgaaaaggtgtttatctctgggggaggaggaaatggcgaacaagtaccagggcattcgcttactctaatgactgcagttgagtcttcaggccaaaatagaaacctgtagatgggagctctctctccacctccgccccgcccccccgcgcaccgccaccccaagtttataaatagaagtttccagtatcctcagtatcctatttggaagactttccaatactagagactgaagcattggctagttttaagggtgtgttggtagggacagtaaggctagatgctgttcatgaaaactagggacttgaaggagacagctagacaaagtgggaattctccaattgtcccttttcttttcagttttgaagggttttattccaatgctttcttgaaaagactaacttattctcggtttggtggataggaatgggactctaaattcttaagttgtcgtttgctgagcccttgaagagttccagttattggttgagtaaatggtagccatggctagatgtcaaaacccttccttccctctatcccctacagggtaatgacactcacaacccactttgttgtgaaaaacttagagatttagaggaggcggtgcagcagcgccacccctcggtgggtgaaactattggcaaaagtcaatttttgaaaaatattgggaagtgaacttatgaaacattttttcccccagagatttaaaaaaaaaagggggggggataaaactaacggataaaaaggactttgcagtttatcaagtagggaagaaaaatgttgctttccaactaggatggtgttataataggcaacgtggttcatatatatatatatatatatatatatatatatatatatatttggtggggggagggtcactggttgactttaagtagaagagttctccaggcggaggtagcccgaccttccccttggactgacttctcagggcatcttaattttgctgcctgtcggataccgagatagtgagggatgtttaggtgtaaaacaccacagtggctggaaatgctgtagttttgccggcggtggcaggacgtatgtgtagggggtgtgttgaggaggtttgtggatggcgtggagcaatggtaggctggtctgtagccctctgtgagtcaacatcgaatggcgcgtgccggtttccatcactgcgcaacaagtgggaccgccactgccgccgcgagcacagcgagggtgcagcgtagtggtaaaactggctggtttctctttgccccagtggaagccaggaacggcccccccaaccctcccgagacccacaacttcaccaaaagaccttacccgactccccactcccccgctttgccagccgcagtgagcctgagtgggatccagctctcggcccccagcgcccctttcctccgagaagatcaggagtttattcccgactttctttgctggacgaccagtgtttggcaagaatatgtgccaatgccgtcgagtgccattctgctttttgaagacaagtgcaccttctttcccttcccagtacataaagcttttcgggagatgggagggggggaaatcaacttatgatacatgaaaccagcccccagataccacgttgcggttgctacaggcgggagcatggggaagaacggaatgccatccactaaattaaatgttttctagctttgcttttagaggcaatcacacccccaaccctcgcccccaccagacagaaaataaagagggacgggtagggatcggtgtggaagttgcggccgcgcggcgattctcggacgggctggcctgccacctagcggtgggctgagatcgagttcgcggccatgggcggtgggctcgctgttccacctctcgggcggcggtgccctgaccagatgctaggactgacagaaggagggcaccctccaatggggatggcatgcaacctccaaagttttgacaagagggatgaaaaatcagaaaggcctcgctgcttgcccatcactcagcgatgagcatctatttccactaaaagaaaccacaaataacccgcttcgaacacaccatcttcctgtccctgtggcccttcttaggggaagtcggtagtggaaggatgccatctaggagctcaggggctttgggacgtacaactctgttttacagttgaggaaacaggcccaacaaggaggcttgttagtggtgagttagtgtcttaaccaggaccagattttaagcttctgaatttcatgtcagtgactgaaagtcacaggcgggtttatctcagctcctttgaagtatttatgagaatggatcggcagccagaaccatgagcttaacctcttaggccacctttgttgccagtgctcattggaaaccgctccgcagcagtcttggaggattttttttttttttttaagaaaatatggcctaagattttcggtaatagacaagaaaagcctagatggtgctgaggggtgtgggtctcggagctcgtgggtttgcgtgttaagatggggattaaggcctgggccaaagacttgcttggcgagcctcgatcctgaaatcgctcccttccccttcctaacatccattgcatagtagcctggcgagaaaccgtgtgtgtgtgtgtgtgtgtgtgtgtgtgtgtgtgtgtgtgtgtgagagagagagagagagagagagagagagagagagagagagagagagagagagagagggagagagggtgggggtcatgtggataggccagaatttgtgccgcaacagctcctccgtaaagttttctttctccgagctcgtgacttaagatggcaaacgcgcgtccgcatgctggcggcccctagcggcagccggcgcgctctgcagcgggagacgcgccgtgtcccccgcccaggtccgcggggatcgaattcagcctctcccactgcgggagccgtccgaggccgcgtcggagaaacgcgcctctgttcgggctggaaacgaatctgggaacgtgtttgaagcgcggtcaagtttgactcatcgctttccaaggacagttagtgccttccatcttcattaacgtgaataaggaccttggctgacttctttccagatcggatttttaaaggcattgtttgcttgaggagatcatgcttctcccctcccccgccagcccttttgcaaaggctgagcccagtccagcccggacggccgagggatctctgctccgggacgcgatttgctggcattgtcttcgggcccttctggaaggctgtctcgcgctgagcgtatggggaacgtcccttttgcaactcctcttcagatcttgatgataaaacacatccctctgttttattgcatttcctagaagcttgcaggcttgcaagagcactttggcaggaaacgtgatagaaatgaaagtcaggacataatgtccccgaacacctcggttatccaaagcggctgccgaggccatcgcgttatcaaattcgcttttatccactgtcgcctcctgtaccctcccgtcccccagccaagagggcgaagagtgtcttcccccaagaataaaagcaactccgccgtttgacctcacccctgccgccggaccacggtggtgtctgcagctgtgcagctagttggctgagacaccgctgagaccgggagccccacggcagggcccctgatgcggggttcactacggcagttccagccttattaaaattccttatccttgtccctaaacagtgctttacactttcaaatttccctttggatttttcagcgggttattggagtcattagattaccaataatccaacagccggcctggctagagaggagggggaagggcggaaggcattctccaaatcgggaggctctggccaaactaggtcaatgggaaggaggggaggggcgagaaaggggttgacggtttcaaaccttgatggagggctctctctagtgttaggcagcggtaaaaacaccattaggtttgagctcccggaaccacgggactcctaatttccaataaatgcacttacttaattttaacttcccagattctcatctctaccccatattaaatcccaaccgtctctttcacctttatcctaccgggcgaaggggtgagaaagcctcagtgtaggattttgagaccaaagaggctccgtctttgcagaccgactctgacccttccgctgccgcagaagggatgagcggcgcagtgtgacgccactggctagttttaggatcagactgcggcctttgtggctgagtctttcactgtcccctgacccccgaaagcgcaccccggagcctgctaccgaggccaattaggacatggcacccgggagggccacaggaaggcgaggcaactttggagagtgccagtgcgtgcgcaggggtcggggccccggcctctgccgagtccaagcagtgtctctacggtttcggggaaatcggtttcggaaatccttacagcttggcagctcctattctaaagactttgggcggaaaccaaggggagctgggttcccgttcttgccaacgtaggcggaaggggctttcgatttagtttttctccaaccttgccaggggcgcctatgatggagaccctcagcccctagggactccatctttttgaccttgaagtctcgcccaaacattcccctaaaagaaaggcggtgagggagaatggaaggcaaaaagagggaaaaaagcaaataaacttcggaatcggacaacttaaagtctcgatatgagcctcggattgtattcgaactcctgggttctagacccagctctgctactaacttgtctgaccttccctatttataaatggttgcgggtgagaggttggactaggtgaactctgagagccctgcactcggcgcggacgagggatttaggggaaagtgtgctgtattccccgcgagccttccccggcggccccgcctccccgggtgaatccccggcggccggcacagcgcaggcagcgatcctggcggctgcccgggcccggcagcttcctggaaagttacttcttgttggagccggcgataggcaaagtgtgttctgtgaaatccgcagagccgagattgactacgttccgggaatgagagggctgtgccattcccctcattgcccgctgccttgacagcgtaacaggggaaaaaaaaaaaaaaggcatacacacaatgttagctaccgaggtgcacgaaaggttttatttgaatgtaactaaattaagggccgccacggtcataccacaaagcctccgtcgcgccttgcggggggcttcgaggtggatcgcccaggggcgggcagtccctggaagacaggttttgagcaaaattttggactgtgaagcaaggcattggtgaagacaaaatggcctcgccggctgacagctgcatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatcttcacagaccagttgaaatgcaaccttagtgtgatcaatctagatcctgagatcaaccctgagggcttctgcatcctcctggactttatgtacacatctcggctcaatttgcgggagggcaacatcatggctgtgatggccacagctatgtacttgcagatggagcatgttgtggacacctgccggaagtttatcaaggccagtgaagcagagatggttcctgccatcaagccccgtcacgaagagttcctcaacagccgcatgctgatgcctcaagacatcatggcctatcggggtcgtgaggtggtggagaacaacctgccactgaggaacgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggccctgccgtgcgatagtaccaggccagtccccggtgagtacagccggccggccttggaggtgtcccccagtgtgtgccacagcaatatctattcacccaaggaaacagtcccagaagaggcacgaagcgatatgcactacagtgtggctgagggcctcaagcctgctgccccctcagcccgaaatgccccctacttcccctgtgacaaggccagcaaagaagaagagagaccctcctcagaagatgagattgccctgcatttcgagccccccaatgcacccctgaaccggaagggtctggttagtccacagagcccccagaaatctgactgccagcccaactcgcccacagaatcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaggggccagagcaggctgagctgggccgcctttccccacgagcctacactgccccacctgcctgccagccacctatggagcctgagaaccttgacctccagtccccaaccaagctcagtgccagcggggaggactccaccatcccgcaagccagccggctcaataacatcgttaacaggtccctgacaggctctccccgcagcagcagtgagagccactcaccactctacatgcaccccccgaagtgcacgtcctgcggctctcagtccccacagcatgcagagatgtgcctccacaccgccggccccacgttccctgaggagatgggagagacccagtctgagtactcagattccagctgtgagaacggggccttcttctgcaatgagtgtgactgccgcttctctgaggaggcctcactcaagaggcacacgctgcagacccacagtgacaaaccctacaagtgtgatcgctgccaggcctccttccgctacaagggcaacctcgccagccacaagaccgtccatacgggtgagaaaccgtatcgctgcaacatctgtggggcccagttcaaccgaccagccaacctgaaaacccacactcgaatccactctggagagaagccctacaaatgcgaaacctgtggagccagatttgtacaggtggcgcacctccgtgcccacgtgctcatccacactggtgagaagccctatccctgtgaaatctgtggcacccgtttccggcaccttcagactctgaagagccatctgcgaatccacacgggagagaaaccttaccattgtgagaagtgtaacctgcatttccgtcacaaaagccagctgcgacttcacttgcgccagaagcatggtgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggacggggagccgcagcagctccccctcccccactgccataaaacattaagaaaatcatattgcttcttctcctatgtgtaaggtgaaccacgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgtcaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaacaaaaagaacaaaaaaatctgcagaaggaaaaacgtgtaattttgttctagttttcagtttgtatataccggtacaacgtgtcctcacggtgccttttttcacggaagtgttcaatgacgggcgagcgtgtgccatcccgttttgaagtgtaggcagacacagggacttgaagttgttactaactaaactctctttgggaatgtgtgtctcatcccattctgcgtcatgcttgtgttgttactactccggagacagggtttggctgtgtctaaactgcatcaccgcgttgtaaaatatagctgtacaaatatcagaataaaatgctgaaaagtcaa

SEQ ID NO: 24 - protein, 706 aa, Chlorocebus sabaeus; identical to SEQ ID NO: 20

SEQ ID NO: 25 - DNA, 3566 bp, Saimiri boliviensis boliviensis
  CDS (366)..(2486)
accatcgtcccgggccccgggagggagagccacaggcaggcccctccagcctcgaacccgaacctccaaatccgagacgctctgctgatgaggacctcgaaatatgccggccggtaaaaaaatcttgtggctctgacggcttttgatcggccaggggaggcaaaaatctcggcgagctgacaccaggtcctcccctgccacgtagcagtggtaaagtccgaagctcaaattccgagaattgagctctgttgattcttagaactggggttcttagaagtggtgatgcaagaagtttctaggaaaggccggacaccaggttttaagcaaaattttggactttgaagcaagacattggtgaagacaaaatggcctcgccggctgacagctgtatccagttcacccgccatgccagtgacgttcttctcaaccttaatcgtctccggagtcgagacatcttgactgatgttgtcattgttgtgagccgtgagcagtttagagcccataaaacagtcctcatggcctgcagtggcctgttctatagcatcttcacagaccagttgaaatgcaaccttagtgtgatcaatttagatcctgagatcaaccccgaggggttctgcatcctcctggactttatgtacacgtctcgactcaatttgcgggagggcaacatcatggccgtaatggccacagctatgtacctgcagatggagcatgttgtggatacttgccggaagttcatcaaggccagtgaagcagagatggttcctgccatcaagcctccccgtgaagagttcctcaacagccggatgctgatgccccaagacattatggcttatcggggccgtgaggtggtggagaacagcctgccgctgaggagtgcccctgggtgtgagagcagagcctttgcccccagcctgtacagtggcctgtccacaccaccagcctcttaccccatgtacagccacctccccgtcagcagcttcctcttctccgatgaggagcttcgagatgtccgcatgcctgtggccaaccccttccccaaggagcgggccctcccgtgcgacagtgccaggccagtccccggtgagtacagccggctggccttagaggagtcccctggcgtgtgccatggcaatatctattcgcccaaggaaacagtcccagaagaggcacgaagtgacatgcactacggtgtggccgagggacccaagcctgctgccccctcagcccgaaacgccccctacttcccctgtgacaaggccagcaaagaagaagagagaccctcctcagaagatgagattgccttgcatttcgagccccccaatgcgcccctgaaccggaagggtctggtgagtccacagagcccccagaaatctgactgccagcccaactcgcctacagagtcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaagggccagagcaggctgagctgggccgcctttccccacgagcctacaccgccccgcctgtctgccagccacccatggagcctgagaaccttgacctccagtccccaaccaagctcagcgccagcggggaggactccaccatcccacaagccagccggctcaataacatcgttaacaggtccctgacgggctctccccgcagcagcagtgagagccactcaccgctctacatgcacccgccgaagtgcgcgtcctgtggctctcagtccccacagcatgcagagatgtgcctgcacactgccggacccacgttccccgaggagatgggagagacccagtctgagtactcggattccagctgtgagaacggagccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagactgtccacaccggtgagaaaccctatcgttgcaacatctgtggggcccagttcaaccggccagccaacctgaaaacccacactcgaattcactctggagagaagccctacaaatgcgaaacctgtggagccagatttgtacaggtggcccacctccgtgcccatgtgctcatccacactggcgagaagccctatccctgtgaaatctgtggcacccgtttccggcaccttcagactctgaagagccacctgcgaatccacacgggagagaaaccttaccattgtgagaagtgtaacctgcatttccgtcacaaaagccagctgcgacttcacttgcgccagaagcatggcgccatcaccaacaccaaggtgcaataccgcgtgtcggccacagacctgcctccggagctccccaaagcctgctgaagcatggagtgttgatgctttttcctctccagccccttctcagaatctacccaaaggatactgtaacactttacaatgttcatcccatgatgtagtgcctctttcatccactagtgcaaatcatagctgggggtggggggtgtcgggggtcggggcctgggggattgggagtcacggcagctccccctcccccactgccataaaacattaagaaaataatattgcttcttctcctatgtgtaaggtgaaccacgtcagcaaaaagcaaaatcattttctatgtcaaagcggggagtatgcaaaaagttctgacttgactttagtctgcaaaatgaggaatgtatatgtttcgtgggaacagatgtttcttttgtatgtaaatgtgcattcttttaaaagacaagacttcggtatgttataaaagagagggctttaatttttttaaccaaaggtgaaggaatatatggcagagctgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaagaacaaaaaaacccgcagaaggaaaacgtgtaattttgttctagttttcagtttgtatatacctgtacaacgtgtcctcacggtgccttttttcatggaagttttcaatgatgggcgagcgtgcgccattccgttttgaagcgtaggcagacacagggacttgaagttgttactaactaaactctctttgggaacgtttgtctcatcccattctgcgtcatgcttgtgttataactactccggagacagggtttggctgtgtctaaactgcattaccgcgttgtaaaatatagctgtacaaatataagaataaaatgttgaaaagtcaa

SEQ ID NO: 26 - protein, 706 aa, Saimiri boliviensis boliviensis
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREEFLNSRMLMPQDIMAYRGREVVENSLPLRSAPGCESRAFAPSLYSGLSTPPASYPMYSHLPVSSFLFSDEELRDVRMPVANPFPKERALPCDSARPVPGEYSRLALEESPGVCHGNIYSPKETVPEEARSDMHYGVAEGPKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPVCQPPMEPENLDLQSPTKLSASGEDSTIPQASRLNNIVNRSLTGSPRSSSESHSPLYMHPPKCASCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 27 - DNA, 3272 bp, Saimiri boliviensis boliviensis
  CDS (72)..(2192)
ggaattgaaaaaagattgagaggttttaagcaaaattttggactttgaagcaagacattggtgaagacaaaatggcctcgccggctgacagctgtatccagttcacccgccatgccagtgacgttcttctcaaccttaatcgtctccggagtcgagacatcttgactgatgttgtcattgttgtgagccgtgagcagtttagagcccataaaacagtcctcatggcctgcagtggcctgttctatagcatcttcacagaccagttgaaatgcaaccttagtgtgatcaatttagatcctgagatcaaccccgaggggttctgcatcctcctggactttatgtacacgtctcgactcaatttgcgggagggcaacatcatggccgtaatggccacagctatgtacctgcagatggagcatgttgtggatacttgccggaagttcatcaaggccagtgaagcagagatggttcctgccatcaagcctccccgtgaagagttcctcaacagccggatgctgatgccccaagacattatggcttatcggggccgtgaggtggtggagaacagcctgccgctgaggagtgcccctgggtgtgagagcagagcctttgcccccagcctgtacagtggcctgtccacaccaccagcctcttaccccatgtacagccacctccccgtcagcagcttcctcttctccgatgaggagcttcgagatgtccgcatgcctgtggccaaccccttccccaaggagcgggccctcccgtgcgacagtgccaggccagtccccggtgagtacagccggctggccttagaggagtcccctggcgtgtgccatggcaatatctattcgcccaaggaaacagtcccagaagaggcacgaagtgacatgcactacggtgtggccgagggacccaagcctgctgccccctcagcccgaaacgccccctacttcccctgtgacaaggccagcaaagaagaagagagaccctcctcagaagatgagattgccttgcatttcgagccccccaatgcgcccctgaaccggaagggtctggtgagtccacagagcccccagaaatctgactgccagcccaactcgcctacagagtcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaagggccagagcaggctgagctgggccgcctttccccacgagcctacaccgccccgcctgtctgccagccacccatggagcctgagaaccttgacctccagtccccaaccaagctcagcgccagcggggaggactccaccatcccacaagccagccggctcaataacatcgttaacaggtccctgacgggctctccccgcagcagcagtgagagccactcaccgctctacatgcacccgccgaagtgcgcgtcctgtggctctcagtccccacagcatgcagagatgtgcctgcacactgccggacccacgttccccgaggagatgggagagacccagtctgagtactcggattccagctgtgagaacggagccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagactgtccacaccggtgagaaaccctatcgttgcaacatctgtggggcccagttcaaccggccagccaacctgaaaacccacactcgaattcactctggagagaagccctacaaatgcgaaacctgtggagccagatttgtacaggtggcccacctccgtgcccatgtgctcatccacactggcgagaagccctatccctgtgaaatctgtggcacccgtttccggcaccttcagactctgaagagccacctgcgaatccacacgggagagaaaccttaccattgtgagaagtgtaacctgcatttccgtcacaaaagccagctgcgacttcacttgcgccagaagcatggcgccatcaccaacaccaaggtgcaataccgcgtgtcggccacagacctgcctccggagctccccaaagcctgctgaagcatggagtgttgatgctttttcctctccagccccttctcagaatctacccaaaggatactgtaacactttacaatgttcatcccatgatgtagtgcctctttcatccactagtgcaaatcatagctgggggtggggggtgtcgggggtcggggcctgggggattgggagtcacggcagctccccctcccccactgccataaaacattaagaaaataatattgcttcttctcctatgtgtaaggtgaaccacgtcagcaaaaagcaaaatcattttctatgtcaaagcggggagtatgcaaaaagttctgacttgactttagtctgcaaaatgaggaatgtatatgtttcgtgggaacagatgtttcttttgtatgtaaatgtgcattcttttaaaagacaagacttcggtatgttataaaagagagggctttaatttttttaaccaaaggtgaaggaatatatggcagagctgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaagaacaaaaaaacccgcagaaggaaaacgtgtaattttgttctagttttcagtttgtatatacctgtacaacgtgtcctcacggtgccttttttcatggaagttttcaatgatgggcgagcgtgcgccattccgttttgaagcgtaggcagacacagggacttgaagttgttactaactaaactctctttgggaacgtttgtctcatcccattctgcgtcatgcttgtgttataactactccggagacagggtttggctgtgtctaaactgcattaccgcgttgtaaaatatagctgtacaaatataagaataaaatgttgaaaagtcaa

SEQ ID NO: 28 - protein, 706 aa, Saimiri boliviensis boliviensis; identical to SEQ ID NO: 26

SEQ ID NO: 29 - DNA, 7777 bp, Saimiri boliviensis boliviensis
  CDS (4577)..(6697)
tttcatgccagtgtctgagagtcaaaggcgggttgatctcagctcctttgaagtatccacgagaaaggagcgacggccagaaccaggagtccaacctcttaggatgccttgtttgtcagcagtcattggaaaccgttccccagcagtcctggaggaattgtttttttttttttttttttttttttttaaagaaaatatggcttcagattttcggtaataggaaaagcccagatggtgctgaggggtgggggtctcgagctcgggggttcgcgtgttaggcagggtcgggggtgaaggcctgggccaaagacttgcaggggcgagcctcgatcctcacaccgctctcttccccttccttccatcccttgcatggctgcctggcgagaaaccgggtgtgtgtgtgtgaggggccgggggccacgcggactggccagagtccgtgccacaacagcccctccgtaaagttttcttcttccgagctcgtgacttaagatggcaaacgcgcgtccgcaggctggcggcccctagcggcggccggcgcactctgcagcgggaggcggcgccgtcgcccccgcccgggtccgcggggatcgagttcagcctgtcccactgcgggagccgtcggaggccgcgtcggagaaacgcgcctctgttcgggctggaaacgaatctgggaacgtgtttgaagcgcggtcaagtttgactcatcgctttccaaggacagttagtgccttccatcttcattaacgtgaataagaaccttggctgacttctttccagatcgaatttttaaaggcattgtttgcttgaggagatcatgcctctcccctcccccgccagccttttttttttttttttcaaaggctgagcccaatccagccaggatggccgagggatctctgccccgggacgtgatttgctggcactgtcttcgagccgttctggaaggctgtcttgagctgagcgtttggggagcgtcctttctgcaactcctcttcagatcttgatgataaaacacatccttctgttttattgcatttcctagaagcttgcaggcttgtaagagcgctgttggcaggaaacgtgatagaaatgaaagtcaggacatcttgtccccggacacctcggttacctaaagcggctgccgaggccatcgtgttatcaaatttgcttttatccactgtcgcctcccgcaccctcccgtcccccagacaagagggcgaagagtgtttttccctaagaataaaaacaactcagcggtctgacctcaccccctgccgccggaccacagtggtgtctacggccgtgcagagactctacggagaccgggagccccaccgcagggcccctgatgcggggttcactccggcagctccagccttattaaaattccttgtccttgtccctaaacagtgctttacactttcaaattcccctttggatttttcagcgagttattggagttattagattaccaataatccaacagccggcctggctggagagtcggggggaagggcggaaggcattctccaaatcaggaggctctggccaaactaggtcaatgggaaggaggggaggggcgagaaagggctggacggtttcaaaccttgatggagggctctctctagtgttaggcagcggcaaaaacacccttaggtctgagctcccggaaccacgggactcctaattgccaataaatgcacttacttgagtttaacttcccagatgctcatccctaccccatattaaaacccagccttctctttcacctttatccccccgggcgaaggggtgggaaggcctccatgtagaattttgaggccgaagaggctcagcctctgcgcaccgactctgacctttccgctgccgcagaagggctgagcggcgcagcgtggcgccactggctggttttaggacctgactgcggccttggttgctgagtctttcgctgtcccctgacccctaaaagcgcaccccggagcctgctaccgagaccaaataggacagggcatcccggggttatcattcccgggagggccgcgggaagacgaggcaagtgtggagagcgcccgtgtccgcgcaggggtcggggctgggcctctgcccagtccaagccgggtctctacggtttcgggaaaatcgggttcagaaatccttacggcccggcagctcctattctgaagactttgggcggaaaccaagcggagctgggttcccgttcttgccaacgtcggcggaaggggctttcggtttagtttttctccaaccttggctggggcgcctttgatggagaccctcagcagtagggattccatctttttgaccttgaagtctcgccctaacatccccctaaaagaaggggggcgagggagaatggaaggcaaaaagaggaaaaaaagcaaataaacttcggaatcgggcaacttaaagtcacgatatgagcctcggattggattccaactcctgggttctagtcccagctctgctgctaactgaccttccccgttgataaactgttgtgggtgagaggttggactaggtgaactctgagagccctggacttggcgcagacgagggatttaggggaaagtgtgctgtattccccgcgagccttccccggcggccccgcctccccgggtgaatccccggcggccggcgcagcgcaggcggcgatcctggcggctgccgggcccggcagcttcctggaaagttacttctcgttggagccggcgataggcagagcaggttctgcgaaatccgcagagccgagattgactacgttccgggaatgagagggctgtgccattcccctcattgcctgatgtcttgacggcgtaacaggaaaaaaaaaaaaaaaaaaaaaaaaaaaaaaaaaaaaaaaggcatacacaccatgttagctaccgaggtgcatgaaaagttttatttgaatgtaactaaattaagggccgccacagtcatcccacaaagtctcggtcccgccttgcggggggcttggaggtggatcgcccaggggcgggcagtccctggaagacaggtacggtgtcgtcggggtggggcagtgaggtctgcccaggcttgccccggcccgcagggctcctgtttgtgctcttgtgtgtgaaggagaaaatggggctgcctggtgccagcccaggggaggagggaggaaaagaatggggtctttggtattggctagctctctgcctcttaacatcgcccctggctcttctctcattctctctctctctctctctctctctctctctctctctctctggcttctgctgctgtcttctctctctttgcttttttatttttggttcctgttttcttcttcagtggaaagctcttttaatggatctgccttctcaaggagcctagttggatatgcacaaggaaagctcccaaggagctaaagggaagaagggaggaggaaacaccgagctctcccatggtggttactgagcccgcgggggtgcgggacgttgggatgggaagtccgggtctgggggcggcggctgtcagtttctcattgacagccctgcttttcctcggagattgtttttgcgggtagtcttgtgtgtggcattggcggcagggctgaatctaggagatgcgacctgtccaggacttgctggaaattggctttgagatcttaggcaaggcttctcacctggagcttcagttccctccctgatcaatcggggctgttagaaggatacgatgcaatcgtgaggggtgggaaaggaccgagagctgtgtaccaaagcaaactaaatgctggtggtgcttccacacctgcggcgtctagggtgggggcggtgacggcattgcccacactcaacccccaggctcaggagttggggggagggcctcttaagaagagctggcttacaaaggagtgagcttgataaggacctgcgccttgtgtgtgtctatttatttgcttttggtcaggcagaggcttaaggtgaaaagcccaagtcccaactgaccgtggacacaggggaacttgtttgtttgtttcattctgcatctggagtgagtcatggccacttgtcatggtgaaatggcaaatctgggcttcctgtggttccagaagcctgtgcctggaaatccacaagcgagctggtggttgaagctggttaaagaacagcctaggtattccagaagtgtttgaggatcgcttccatgagggaagagaggcaagtttataagtaaacctcccatgtgtcttcagctttcttttgtgaaggagaaaatctttgcagtttggttaagaccgagttagtatagctgtcttggcctatcctgagttggatggggagaggaggggataggttctttggtctttttctgtcctctcctttccccacttccttccccgcagcccccacttgctcacatgcacacactaaccttggagccgatgggattgagtgactggcacttgggaccacagagaaatgtcagagtgtttggttacagactcaaggaaacctctcattttagagtgctcatttggttttaagcaaaattttggactttgaagcaagacattggtgaagacaaaatggcctcgccggctgacagctgtatccagttcacccgccatgccagtgacgttcttctcaaccttaatcgtctccggagtcgagacatcttgactgatgttgtcattgttgtgagccgtgagcagtttagagcccataaaacagtcctcatggcctgcagtggcctgttctatagcatcttcacagaccagttgaaatgcaaccttagtgtgatcaatttagatcctgagatcaaccccgaggggttctgcatcctcctggactttatgtacacgtctcgactcaatttgcgggagggcaacatcatggccgtaatggccacagctatgtacctgcagatggagcatgttgtggatacttgccggaagttcatcaaggccagtgaagcagagatggttcctgccatcaagcctccccgtgaagagttcctcaacagccggatgctgatgccccaagacattatggcttatcggggccgtgaggtggtggagaacagcctgccgctgaggagtgcccctgggtgtgagagcagagcctttgcccccagcctgtacagtggcctgtccacaccaccagcctcttaccccatgtacagccacctccccgtcagcagcttcctcttctccgatgaggagcttcgagatgtccgcatgcctgtggccaaccccttccccaaggagcgggccctcccgtgcgacagtgccaggccagtccccggtgagtacagccggctggccttagaggagtcccctggcgtgtgccatggcaatatctattcgcccaaggaaacagtcccagaagaggcacgaagtgacatgcactacggtgtggccgagggacccaagcctgctgccccctcagcccgaaacgccccctacttcccctgtgacaaggccagcaaagaagaagagagaccctcctcagaagatgagattgccttgcatttcgagccccccaatgcgcccctgaaccggaagggtctggtgagtccacagagcccccagaaatctgactgccagcccaactcgcctacagagtcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaagggccagagcaggctgagctgggccgcctttccccacgagcctacaccgccccgcctgtctgccagccacccatggagcctgagaaccttgacctccagtccccaaccaagctcagcgccagcggggaggactccaccatcccacaagccagccggctcaataacatcgttaacaggtccctgacgggctctccccgcagcagcagtgagagccactcaccgctctacatgcacccgccgaagtgcgcgtcctgtggctctcagtccccacagcatgcagagatgtgcctgcacactgccggacccacgttccccgaggagatgggagagacccagtctgagtactcggattccagctgtgagaacggagccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagactgtccacaccggtgagaaaccctatcgttgcaacatctgtggggcccagttcaaccggccagccaacctgaaaacccacactcgaattcactctggagagaagccctacaaatgcgaaacctgtggagccagatttgtacaggtggcccacctccgtgcccatgtgctcatccacactggcgagaagccctatccctgtgaaatctgtggcacccgtttccggcaccttcagactctgaagagccacctgcgaatccacacgggagagaaaccttaccattgtgagaagtgtaacctgcatttccgtcacaaaagccagctgcgacttcacttgcgccagaagcatggcgccatcaccaacaccaaggtgcaataccgcgtgtcggccacagacctgcctccggagctccccaaagcctgctgaagcatggagtgttgatgctttttcctctccagccccttctcagaatctacccaaaggatactgtaacactttacaatgttcatcccatgatgtagtgcctctttcatccactagtgcaaatcatagctgggggtggggggtgtcgggggtcggggcctgggggattgggagtcacggcagctccccctcccccactgccataaaacattaagaaaataatattgcttcttctcctatgtgtaaggtgaaccacgtcagcaaaaagcaaaatcattttctatgtcaaagcggggagtatgcaaaaagttctgacttgactttagtctgcaaaatgaggaatgtatatgtttcgtgggaacagatgtttcttttgtatgtaaatgtgcattcttttaaaagacaagacttcggtatgttataaaagagagggctttaatttttttaaccaaaggtgaaggaatatatggcagagctgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaagaacaaaaaaacccgcagaaggaaaacgtgtaattttgttctagttttcagtttgtatatacctgtacaacgtgtcctcacggtgccttttttcatggaagttttcaatgatgggcgagcgtgcgccattccgttttgaagcgtaggcagacacagggacttgaagttgttactaactaaactctctttgggaacgtttgtctcatcccattctgcgtcatgcttgtgttataactactccggagacagggtttggctgtgtctaaactgcattaccgcgttgtaaaatatagctgtacaaatataagaataaaatgttgaaaagtcaa

SEQ ID NO: 30 - protein, 706 aa, Saimiri boliviensis boliviensis; identical to SEQ ID NO: 26

SEQ ID NO: 31 - DNA, 2985 bp, Pongo abelii
  CDS (109)..(2229)
agaactggggttcttagaagtggtgatgcaagaagtttctaggaaaggccggacaccaggttttgagcaaaattttggactgtgaagcaaggcattggtgaagacaaaatggcctcaccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgaggggttctgcatcctcctggactttatgtacacatctcggctcaatttgcgggagggcaacatcatggctgtgatggccacagctatgtacctgcagatggagcatgttgtggacacttgccggaagtttatcaaggccagtgaagcagagatggttcctaccatcaagccccctcgtgaagagttcctcaacagccggatgctgatgccgcaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggccctcccatgtgatagtgccaggccagtccctggtgagtacagccggccgactttggaggtgtcccccaatgtgtgtcacagcaatatctattcacccaaggaaacagtcccagaagaggcacgaagtgatatgcactacagtgtggctgagggcctcaagcctgctgccccctcagcccgaaatgcgccctacttcccttgtgacaaggccagcaaagaagaagagagaccctcctcagaagatgagattgcccttcatttcgagccccccaatgcacccctgaaccggaagggtctggttagtccacagagcccccagaaatctgactgccagcccaactcacccacagagtcctgcagcagtaagaatgcctgcatcccccaggcctctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacactgccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactctacatgcaccccccgaagtgcacatcctgcggctctcagtccccacagcatgcagagatgtgcctccacaccgctggccccacgtttcctgaggagatgggagagacccagtctgagtactcagattccagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgtaacatctgtggggcccagttcaaccggccagccaacttgaaaacccacactcgaattcactctggagagaagccctacaaatgcgaaacctgtggagccagatttgtgcaggtggctcacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagtcagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggactgggagccgcagcaggctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtagatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaacaaaaaaaaaaaaaaa

SEQ ID NO: 32 - protein, 706 aa, Pongo abelii
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPTIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETVPEEARSDMHYSVAEGLKPAAPSARNAPYFPCDKASKEEERPSSEDEIALHFEPPNAPLNRKGLVSPQSPQKSDCQPNSPTESCSSKNACIPQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 33 - DNA, 2906 bp, Gorilla gorilla gorilla
  CDS (657)..(2777)
attttattttttttctcttactcgcctctctaaccctactatatatataaaacatacttttcccagtggttcaaacctctcgctcccttttgtgcatttagctcgatctgctgagtttatgggtaagaaagaaggaattagccccagaccccgggaaagcaaagcgcactccccctcttatgtcaccgaatagcaaattagttctcagaattccagaggccgagctttgctacagcgaaggcgccgacgtcacagaggaggagcccacgtgacggtggcggagcaggccataccatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgaggggttctgcatcctcctggactttatgtacacatctcggctcaatttgcgggagggcaacatcatggctgtgatggccacggctatgtacctgcagatggagcatgttgtggacacttgccggaagtttatcaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagttcctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactctacatgcaccccccaaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctggg

SEQ ID NO: 34 - protein, 706 aa, Gorilla gorilla gorilla; identical to SEQ ID NO: 8

SEQ ID NO: 35 - DNA, 3563 bp, Orcinus orca
  CDS (366)..(2486)
accatcgtccgggggccggggagggagagccaccgtctggcccctcgagcctcacaccgaaacctccaaacccgagacgcccagcctgtgaggaacccgaaatatgccggacagtgggaaaatattgtggctttgagggttttttatgggccaaagcaggcaaaagtcgcggagagctgacaccgagtcctcccctgccacgtagcagtggtaaggcccgcagctcaaattccgagaattgagctctgttgattcttagaactggggttcttagaagtggtgatgcaagaagtttctaggaaaggccggacaccaggttttaagcaaaattttggactgtgaatcaaggcattgggtaaaaaaaaatggcctcgccggctgacagctgtatccagttcacccgccacgccagtgacgttcttctcaaccttaatcgcctccggagccgtgacatcttgacggatgttgtcatagtggtgagccgggagcagttccgagcccataagacggtcctcatggcctgcagtggcctgttctacagcatcttcacagaccagctgaaatgcaacctcagtgtgatcaacctggatcctgagatcaacccggaggggttctgcatcctcctggacttcatgtacacatctcggctcaatctgcgggagggcaacatcatggctgtgatggccacagctatgtacctgcagatggagcatgttgtggacacttgccggaagttcatcaaggccagtgaagcagagatggtccctgccattaagcctccccgtgaagacttcctgaacagccggatgctgatgccccaggacctcatggcctatcggggccgggaggtggtggagaacagcctgcccctgaggaacgcccctgggtgtgagagcagagccttcgcgcccagcctgtacaatggcctgtccacgccgccagcctcgtaccccatgtatggccaccttccggtcagcagcttcctcttctccgacgaggagctgcgggatgcccggatgcctgtggccaactccttccccaaggagcggaccctcccctgcgacagtgccaggccagtccccagtgagtacagtcggccggccatggagctctcccccactgtgggccacaacaacgtgtactcacccaaggaggcagccctggaggaggcacggagtgatatgcactacagtgtggccgagggccccaagcctgctgccccctcggcccggagcgccccgtacttcgcctgtgacaaggccggcaaagaggaagagaggccctcgtcggaggatgagattgccctgcatttcgagccgcccaatgcacccctgaaccggaagggtctggtgagcccgcagagcccccagaagtccgactgccaacccaactcacccacggagtcctgcagcagcaagaacgcctgcatcctccagacctccgggtcccctccggccaaaagccccactgaccccaaagcctgcaactggaagaagtacaagttcatcgtgctcaacagcctcaaccagaatgccaaaccagaggggcccgagcaggccgagctgggccgcctttcccctcgagcctacactgccccagcggcctgccagccgcccatggagcccgagacccttgacctccagtccccaaccaagctcagcaccagtggggaggactccaccatcccacaggccagcaggctcaataacatcgtcaacaggtcactgaccggctccccacgcagcagcagtgagagccactctccactctacctgcacgcccccaagtgcacgtcctgtggctctcagtccccgcagcacgcagagatgtgcctccacgccactggtcccacgttccccgaggagctgggagagacccagtctgagtactcagattccagctgtgagaacggggccttcttctgcaatgagtgtgactgccgcttttctgaggaggcctccctcaagaggcatacgctgcagacccacagtgacaaaccctacaagtgtgaccgctgccaggcctcctttcgctacaagggcaacctcgccagccacaagaccgtccacacgggtgagaagccctatcgctgtaacatctgcggggcccagttcaaccggccagccaacctgaaaacccacacccgaattcactccggagagaagccctacaagtgcgaaacgtgcggagccagatttgtccaggtggcccacctccgtgcccacgtgctcatccacactggcgagaagccctatccctgtgaaatctgtggcacccgtttccggcaccttcagactctgaagagccacctgcgaatccacacgggagagaaaccttaccattgtgagaaatgtaacctgcatttccgtcacaaaagccagctgcgtcttcacttgcgccagaagcacggtgccattaccaacaccaaggtgcaataccgtgtgtccgccactgacctgcccccggagctccccaaagcctgctgaagcatggagtgttgatgctttccattcgagccccttctcagaatctacccaaaggatactgtaacactttaccatgttcatcccatgatgtagtgcctctttcatccactagtgcaaatcatagctgggggagtgggggggtgggggaggggggggggggggggggggggcccccccccccccccctcccctcccccactgccgtaaaacattaagaaaataatactgcttcttctcctatgtgtaaggcgaaccatgtcagcaaaaagcaaaatcattttatatatcgaagctgggggagtatgcaaaagttctgacttgactcagtctgcaaaatgaggaatgtatatgttttgtgggatcagatgtttcttttgtatgtaaatgtgcattcttttaaaagaagagacttcggtatgttatcaaagagagggctttaatttttttaaccaaaggtgaaggaatatatggcagagttgtaaatatataaatatatatatatatataaaataaatatatataaacctaaaaaagatatattaaaaatataaaaccgcgttaaaggctcgattttgtatctgcaggcagacacggatctgagaatctttatgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaatgtgtagttttgttctagttttcggtttgtatatacctgtacaacgtgtcctacggtgcctttttttcatggaagttttcagtgggcaacgaccgcaccatcccttttggaagtgtaggcagacacagggacttggagttatcactaactaagctctctttgggaatgtttgtctcatcccattctgcgtcatgcttgtgttataactactccggagacagggtttggctgtgtctaaactgcattactgagttgtaaaatatagctgtacaaatacaagaataaaatgttgaaaagtcaa

SEQ ID NO: 36 - protein, 706 aa, Orcinus orca
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREDFLNSRMLMPQDLMAYRGREVVENSLPLRNAPGCESRAFAPSLYNGLSTPPASYPMYGHLPVSSFLFSDEELRDARMPVANSFPKERTLPCDSARPVPSEYSRPAMELSPTVGHNNVYSPKEAALEEARSDMHYSVAEGPKPAAPSARSAPYFACDKAGKEEERPSSEDEIALHFEPPNAPLNRKGLVSPQSPQKSDCQPNSPTESCSSKNACILQTSGSPPAKSPTDPKACNWKKYKFIVLNSLNQNAKPEGPEQAELGRLSPRAYTAPAACQPPMEPETLDLQSPTKLSTSGEDSTIPQASRLNNIVNRSLTGSPRSSSESHSPLYLHAPKCTSCGSQSPQHAEMCLHATGPTFPEELGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 37 - DNA, 3289 bp, Orcinus orca
  CDS (87)..(2207)
ctcaaggaaacctctcattttagagtgctcatttggttttaagcaaaattttggactgtgaatcaaggcattgggtgaagaaaaaaatggcctcgccggctgacagctgtatccagttcacccgccacgccagtgacgttcttctcaaccttaatcgcctccggagccgtgacatcttgacggatgttgtcatagtggtgagccgggagcagttccgagcccataagacggtcctcatggcctgcagtggcctgttctacagcatcttcacagaccagctgaaatgcaacctcagtgtgatcaacctggatcctgagatcaacccggaggggttctgcatcctcctggacttcatgtacacatctcggctcaatctgcgggagggcaacatcatggctgtgatggccacagctatgtacctgcagatggagcatgttgtggacacttgccggaagttcatcaaggccagtgaagcagagatggtccctgccattaagcctccccgtgaagacttcctgaacagccggatgctgatgccccaggacctcatggcctatcggggccgggaggtggtggagaacagcctgcccctgaggaacgcccctgggtgtgagagcagagccttcgcgcccagcctgtacaatggcctgtccacgccgccagcctcgtaccccatgtatggccaccttccggtcagcagcttcctcttctccgacgaggagctgcgggatgcccggatgcctgtggccaactccttccccaaggagcggaccctcccctgcgacagtgccaggccagtccccagtgagtacagtcggccggccatggagctctcccccactgtgggccacaacaacgtgtactcacccaaggaggcagccctggaggaggcacggagtgatatgcactacagtgtggccgagggccccaagcctgctgccccctcggcccggagcgccccgtacttcgcctgtgacaaggccggcaaagaggaagagaggccctcgtcggaggatgagattgccctgcatttcgagccgcccaatgcacccctgaaccggaagggtctggtgagcccgcagagcccccagaagtccgactgccaacccaactcacccacggagtcctgcagcagcaagaacgcctgcatcctccagacctccgggtcccctccggccaaaagccccactgaccccaaagcctgcaactggaagaagtacaagttcatcgtgctcaacagcctcaaccagaatgccaaaccagaggggcccgagcaggccgagctgggccgcctttcccctcgagcctacactgccccagcggcctgccagccgcccatggagcccgagacccttgacctccagtccccaaccaagctcagcaccagtggggaggactccaccatcccacaggccagcaggctcaataacatcgtcaacaggtcactgaccggctccccacgcagcagcagtgagagccactctccactctacctgcacgcccccaagtgcacgtcctgtggctctcagtccccgcagcacgcagagatgtgcctccacgccactggtcccacgttccccgaggagctgggagagacccagtctgagtactcagattccagctgtgagaacggggccttcttctgcaatgagtgtgactgccgcttttctgaggaggcctccctcaagaggcatacgctgcagacccacagtgacaaaccctacaagtgtgaccgctgccaggcctcctttcgctacaagggcaacctcgccagccacaagaccgtccacacgggtgagaagccctatcgctgtaacatctgcggggcccagttcaaccggccagccaacctgaaaacccacacccgaattcactccggagagaagccctacaagtgcgaaacgtgcggagccagatttgtccaggtggcccacctccgtgcccacgtgctcatccacactggcgagaagccctatccctgtgaaatctgtggcacccgtttccggcaccttcagactctgaagagccacctgcgaatccacacgggagagaaaccttaccattgtgagaaatgtaacctgcatttccgtcacaaaagccagctgcgtcttcacttgcgccagaagcacggtgccattaccaacaccaaggtgcaataccgtgtgtccgccactgacctgcccccggagctccccaaagcctgctgaagcatggagtgttgatgctttccattcgagccccttctcagaatctacccaaaggatactgtaacactttaccatgttcatcccatgatgtagtgcctctttcatccactagtgcaaatcatagctgggggagtgggggggtgggggaggggggggggggggggggggggcccccccccccccccctcccctcccccactgccgtaaaacattaagaaaataatactgcttcttctcctatgtgtaaggcgaaccatgtcagcaaaaagcaaaatcattttatatatcgaagctgggggagtatgcaaaagttctgacttgactcagtctgcaaaatgaggaatgtatatgttttgtgggatcagatgtttcttttgtatgtaaatgtgcattcttttaaaagaagagacttcggtatgttatcaaagagagggctttaatttttttaaccaaaggtgaaggaatatatggcagagttgtaaatatataaatatatatatatatataaaataaatatatataaacctaaaaaagatatattaaaaatataaaaccgcgttaaaggctcgattttgtatctgcaggcagacacggatctgagaatctttatgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaatgtgtagttttgttctagttttcggtttgtatatacctgtacaacgtgtcctacggtgcctttttttcatggaagttttcagtgggcaacgaccgcaccatcccttttggaagtgtaggcagacacagggacttggagttatcactaactaagctctctttgggaatgtttgtctcatcccattctgcgtcatgcttgtgttataactactccggagacagggtttggctgtgtctaaactgcattactgagttgtaaaatatagctgtacaaatacaagaataaaatgttgaaaagtcaagtcgg

SEQ ID NO: 38 - protein, 706 aa, Orcinus orca; identical to SEQ ID NO: 36

SEQ ID NO: 39 - DNA, 3323 bp, Canis lupus familiaris
  CDS (135)..(2255)
cgagaattgagctctgttgattcttagaactggggttcttagaagtggtgatgcaagaagtttctaggaaaggccggacaccagattttaagcaaaattttggactgtgaatcaaggcattgggtgaagacaaaatggcctccccggctgacagctgtatccagttcacccgccatgccagtgacgtgcttctcaaccttaatcgcctccgcagccgtgacatcttgactgatgttgtcatcgtggtgagccgtgagcagttcagagcccataagacagtcctcatggcctgcagtggcctgttctacagcatcttcacagaccagttgaaatgtaaccttagtgtgatcaacctggatcctgagatcaaccctgaggggttctgcatcctcctggacttcatgtacacgtctcggctcaatctccgggagggcaacatcatggccgtgatggctacggcgatgtacctgcagatggagcatgtggtggacacctgccggaagtttatcaaggccagtgaagcagagatggttcctgccatcaagcctccccgtgaagagtttctgaatagccggatgctgatgccccaagacatcatggcctatcggggtcgtgaggtggtggagaataacctgccgctgaggaacgcccctgggtgtgagagcagagcctttgcccccagcctgtacagcggcctgtccaccccgccggcctcttatcccgtgtacggccacctcccagtcagcagcttcctcttctccgacgaggagctgcgggatgcccggatgcctgtggccaaccccttccctaaggagcgggccctcccctgcgatagtgccaggcccatccctggtgactacagccggccggccatggagatatcccccaatgtgtgccacagcagcatctactcacccaaggaggcagccccagaggagacacacagtgacatgcactacggtgtggccgagggccccaagcctgccgtcccctccgcccggaatgccccgtacttcccctgtgacaaggccagcaaggaggaagagaggccctcctcggaggatgagatcgccctgcatttcgagccccccagtgcacccctgaaccgcaagggtctggttagtccacagagcccccagaagtctgactgccagcccaactcgcccacggaatcctgcagcagcaagaatgcctgcatcctccagacctctgggtcacctccagctaagagccccaccgaccccaaagcctgcaactggaagaaatataagttcattgtgctgaacagcctcaaccagaatgccaaaccggaggggcccgagcaggccgagctgggccgcctttcccctcgagcctacactgccccgccggcctgccagccacccatggagcctgagagcctcgacctccagtccccaaccaagctcagcgccagtggggaggactccaccatcccacaggccagccggctcaataacatcgtcaacaggtccctgacaggctccccccgcagcagcagcgagagccactcaccgctctacttacacccccccaagtgcacatcctgcggctcgcagtccccacagcacgcggagatgtgcctccacaccgctgggcccacattccccgaggagatgggggagacccagtctgagtactcggattccagctgtgagaacggggccttcttttgcaatgagtgtgactgccgcttctctgaggaggcctcactcaagagacacacgctgcagacccacagtgacaaaccctacaagtgtgaccgctgccaggcctccttccgctacaagggcaacctcgccagccacaagaccgtccatacgggtgagaaaccctatcgctgtaatatctgtggagcccagttcaaccggccagccaacctgaaaactcatactcgaattcactctggagagaagccctacaaatgcgaaacctgtggtgcccgatttgtgcaagtggcccacctccgtgcccacgtgctcatccacactggagagaagccctatccctgtgaaatctgtggcacccgtttccggcaccttcagactctgaagagccacctgcgaatccacacaggagagaaaccttaccattgcgagaagtgcaacctgcatttccgtcacaaaagccagctgcgtcttcacttgcgccagaagcacggcgccatcaccaacaccaaggtacaataccgtgtgtccgccactgacctgcccccggagctccccaaagcctgctgaagcatggagtgttgatgctttccattcgagtcccttctcagaatctacccaaaggatactgtaacactttacaatgttcatcccatgatgtagtgcctctttcatccactagtgcaaatcatagcgggggtgggggtggggggcggggcgtggggactgggggccagagcagctccccgtcccccactgccataaaacattaagaaaataatattgcttcttctcctatgtgtaaggcaaaccatgtcagcaaaaagcaaaatcattttatatatcaaagtgggggagtatgcaaaagttctgacttgacttggtctgcaaaatgaggaatgtatatgtttggtggggacagatgtttcttttgtatgtaaatgtgcattcttttaaaagaagagacttccggtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacacaaaaagaacaaaaaaagctgccgaaggaaaatgtgtagttttgttctagttttcggtttgtatatacctgtacaacgtgtcctacggtgccttttttcatggaagttttcagtgatggacgagcgcgccatcccttctgaagtgtaggcagacacagggacttgaagttgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaatgttgaaaagtcaa

SEQ ID NO: 40 - protein, 706 aa, Canis lupus familiaris
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREEFLNSRMLMPQDIMAYRGREVVENNLPLRNAPGCESRAFAPSLYSGLSTPPASYPVYGHLPVSSFLFSDEELRDARMPVANPFPKERALPCDSARPIPGDYSRPAMEISPNVCHSSIYSPKEAAPEETHSDMHYGVAEGPKPAVPSARNAPYFPCDKASKEEERPSSEDEIALHFEPPSAPLNRKGLVSPQSPQKSDCQPNSPTESCSSKNACILQTSGSPPAKSPTDPKACNWKKYKFIVLNSLNQNAKPEGPEQAELGRLSPRAYTAPPACQPPMEPESLDLQSPTKLSASGEDSTIPQASRLNNIVNRSLTGSPRSSSESHSPLYLHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 41 - DNA, 4437 bp, Canis lupus familiaris
  CDS (1245)..(3365)
tccaactcctttggaagacctgccttctcctcgaggtgcctaattgaaaatccagagctcctgaaaaggcagcggggagaaagtgtgtgggcggaaagacgacgtttaggtgtcgcttggtggttcctgcggctgggggcggggttggggtcgggccagtccaggtctgggcccttgcacttgtcaattctcttttgacagctccgttatcttggcagtttgtttctgtgttaggagtgttgtgtgcggcgtcggtggagtggctgaagctaggtaaaggagtttgtccaggactttgctggagactagcttttagactcgggcaaggcttatccagtggagtctcagtggccttcccagtaaatcagggcagctataaggatcccatacaataacggatgggaaagggctgagtggtctgtgagaaacaaggcagctgttaggtgcttccacacttgcagcatctagagggaggcatggcttcccacatctaccataacacacactcgctagctgtggggtttcctaagatagagctagctgaaggaggagtggacttaatagggatgtgggcctcggtgtatgtgcctttgcttttgaccaagccggacagacactgagaatgaaaatcgcccagccccagggcctggctgacaagtagacccctgggaatagggaatgttttgtttgtttcaatctgcaatatggagtgactcgttgccacttgccaaggtgaaatggcaaatctgggcttcctatggttccgaaagtctgtgactgggaattcgcaagcaagctggtggttgaagctggctaaaggacagctttaggtattccagaagtattcaggggtatctttcatgagggaagaggagacagtttataaatgaaactttcatgtgtcttcagcattctttctcaacagagataatcattgaactttggttaggacccatctggtgtgtctttctttgcccatcttgagttaggatgggagaggaggaagtaggttctttcagtctctttctgtcctctcccttccccccattcccttccctcatcctcactcactcacatgcacacactaaccttgaagccgatgggattgagtgactggcacttgggaccacagagaaatgtcagagtgtttggttacagactcaaggaaacctctcattttagagtgctcatttgattttaagcaaaattttggactgtgaatcaaggcattgggtgaagacaaaatggcctccccggctgacagctgtatccagttcacccgccatgccagtgacgtgcttctcaaccttaatcgcctccgcagccgtgacatcttgactgatgttgtcatcgtggtgagccgtgagcagttcagagcccataagacagtcctcatggcctgcagtggcctgttctacagcatcttcacagaccagttgaaatgtaaccttagtgtgatcaacctggatcctgagatcaaccctgaggggttctgcatcctcctggacttcatgtacacgtctcggctcaatctccgggagggcaacatcatggccgtgatggctacggcgatgtacctgcagatggagcatgtggtggacacctgccggaagtttatcaaggccagtgaagcagagatggttcctgccatcaagcctccccgtgaagagtttctgaatagccggatgctgatgccccaagacatcatggcctatcggggtcgtgaggtggtggagaataacctgccgctgaggaacgcccctgggtgtgagagcagagcctttgcccccagcctgtacagcggcctgtccaccccgccggcctcttatcccgtgtacggccacctcccagtcagcagcttcctcttctccgacgaggagctgcgggatgcccggatgcctgtggccaaccccttccctaaggagcgggccctcccctgcgatagtgccaggcccatccctggtgactacagccggccggccatggagatatcccccaatgtgtgccacagcagcatctactcacccaaggaggcagccccagaggagacacacagtgacatgcactacggtgtggccgagggccccaagcctgccgtcccctccgcccggaatgccccgtacttcccctgtgacaaggccagcaaggaggaagagaggccctcctcggaggatgagatcgccctgcatttcgagccccccagtgcacccctgaaccgcaagggtctggttagtccacagagcccccagaagtctgactgccagcccaactcgcccacggaatcctgcagcagcaagaatgcctgcatcctccagacctctgggtcacctccagctaagagccccaccgaccccaaagcctgcaactggaagaaatataagttcattgtgctgaacagcctcaaccagaatgccaaaccggaggggcccgagcaggccgagctgggccgcctttcccctcgagcctacactgccccgccggcctgccagccacccatggagcctgagagcctcgacctccagtccccaaccaagctcagcgccagtggggaggactccaccatcccacaggccagccggctcaataacatcgtcaacaggtccctgacaggctccccccgcagcagcagcgagagccactcaccgctctacttacacccccccaagtgcacatcctgcggctcgcagtccccacagcacgcggagatgtgcctccacaccgctgggcccacattccccgaggagatgggggagacccagtctgagtactcggattccagctgtgagaacggggccttcttttgcaatgagtgtgactgccgcttctctgaggaggcctcactcaagagacacacgctgcagacccacagtgacaaaccctacaagtgtgaccgctgccaggcctccttccgctacaagggcaacctcgccagccacaagaccgtccatacgggtgagaaaccctatcgctgtaatatctgtggagcccagttcaaccggccagccaacctgaaaactcatactcgaattcactctggagagaagccctacaaatgcgaaacctgtggtgcccgatttgtgcaagtggcccacctccgtgcccacgtgctcatccacactggagagaagccctatccctgtgaaatctgtggcacccgtttccggcaccttcagactctgaagagccacctgcgaatccacacaggagagaaaccttaccattgcgagaagtgcaacctgcatttccgtcacaaaagccagctgcgtcttcacttgcgccagaagcacggcgccatcaccaacaccaaggtacaataccgtgtgtccgccactgacctgcccccggagctccccaaagcctgctgaagcatggagtgttgatgctttccattcgagtcccttctcagaatctacccaaaggatactgtaacactttacaatgttcatcccatgatgtagtgcctctttcatccactagtgcaaatcatagcgggggtgggggtggggggcggggcgtggggactgggggccagagcagctccccgtcccccactgccataaaacattaagaaaataatattgcttcttctcctatgtgtaaggcaaaccatgtcagcaaaaagcaaaatcattttatatatcaaagtgggggagtatgcaaaagttctgacttgacttggtctgcaaaatgaggaatgtatatgtttggtggggacagatgtttcttttgtatgtaaatgtgcattcttttaaaagaagagacttccggtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacacaaaaagaacaaaaaaagctgccgaaggaaaatgtgtagttttgttctagttttcggtttgtatatacctgtacaacgtgtcctacggtgccttttttcatggaagttttcagtgatggacgagcgcgccatcccttctgaagtgtaggcagacacagggacttgaagttgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaatgttgaaaagtcaagtca

SEQ ID NO: 42 - protein, 706 aa, Canis lupus familiaris; identical to SEQ ID NO: 40

SEQ ID NO: 43 - DNA, 4731 bp, Canis lupus familiaris
  CDS (1539)..(3659)
gttctccagatctggagactgtgtctaaagtaggtcaatgggaaggagaggcggggctacacggggcttgtcggcttggagccttggtggagggctctccctagtgtttagccgcggtaagacatgagtaggtttgagctcccggaaccacgggagccctaatttccaataagtgcatgtacttaattttaacttcccttcctagatgctcaccccactccgcattaaatctcaaccttcgctttcacctttattacaccgggcgaagggatgagaaagtctcaaagtgcgactctctgaggccgccgaggcccagtcctcaccgaccggcccgacccgcctccgcggctgccgggatgcgccgcgcgctctgacgccccccgccggctcgaggactggactgcggcctccggcgctgcgtccttcccgcccctcgccccgggagattcctcccggagcccacggccggcgcctgcaaggagagggtgtccggggcttagagccccaaggcaggccccgagagagcgaggcatccttggagcgcgcccgcgcgctggggtcagcgccccggccggcccgcgggagcctaacggcgcctctacggttgcggggaaatcgggttccgaaatcccgaaacctggtcgggttcggcctcgcagctccttttctaaagacttgggggcggaaactgagcctagcagggctcccctacttgccagcgtaggcggaaggggctttcggtttggttttcctgcgcgtcggccgggcgcgcggacggagaccctcagcgcggggactcgctgctgcctgaccttgacgcccggcttcaccgccctcttaaagggggcggaggcaagcaaaaggcaaaaataaatacatgactcacgaggcgagcaaaggccagaattgggcaatttttgaagtcatgaaatgagcctcaggttggccccgaattcctgggttctagatgggctcggctgctaacttgcgcgagtttccccatttataagactgttgcggggggtggggggtggggggagggtcgggtgaatgcagagagctggacccgcgcgggcgagggatttaggggaaagtgcgcctccccgcccccccgtcccctcccctccccgggtgaatccccggcggccctcgcggcgcaggcggcgatcctggcggccgtcgggggccggcagcttcctggaaagttacttctcgttggagccggcgataggcagagagtgttctgtgaaatccgctgagcggagatcgactacgttccgggaatgagagggctgtgccattcccctcactagcccctgccttgacagcgtaacaggaaaaaaaaaaaaaaaaaaggcacacacaatgttagctaccgaagtgcacgaaacgttgtatttgaatgtcaccaaattaagggctgccacggtctctcctcggggcctccgcgggggctgcgcccgggggtgggcggtccctggcgggcagattttaagcaaaattttggactgtgaatcaaggcattgggtgaagacaaaatggcctccccggctgacagctgtatccagttcacccgccatgccagtgacgtgcttctcaaccttaatcgcctccgcagccgtgacatcttgactgatgttgtcatcgtggtgagccgtgagcagttcagagcccataagacagtcctcatggcctgcagtggcctgttctacagcatcttcacagaccagttgaaatgtaaccttagtgtgatcaacctggatcctgagatcaaccctgaggggttctgcatcctcctggacttcatgtacacgtctcggctcaatctccgggagggcaacatcatggccgtgatggctacggcgatgtacctgcagatggagcatgtggtggacacctgccggaagtttatcaaggccagtgaagcagagatggttcctgccatcaagcctccccgtgaagagtttctgaatagccggatgctgatgccccaagacatcatggcctatcggggtcgtgaggtggtggagaataacctgccgctgaggaacgcccctgggtgtgagagcagagcctttgcccccagcctgtacagcggcctgtccaccccgccggcctcttatcccgtgtacggccacctcccagtcagcagcttcctcttctccgacgaggagctgcgggatgcccggatgcctgtggccaaccccttccctaaggagcgggccctcccctgcgatagtgccaggcccatccctggtgactacagccggccggccatggagatatcccccaatgtgtgccacagcagcatctactcacccaaggaggcagccccagaggagacacacagtgacatgcactacggtgtggccgagggccccaagcctgccgtcccctccgcccggaatgccccgtacttcccctgtgacaaggccagcaaggaggaagagaggccctcctcggaggatgagatcgccctgcatttcgagccccccagtgcacccctgaaccgcaagggtctggttagtccacagagcccccagaagtctgactgccagcccaactcgcccacggaatcctgcagcagcaagaatgcctgcatcctccagacctctgggtcacctccagctaagagccccaccgaccccaaagcctgcaactggaagaaatataagttcattgtgctgaacagcctcaaccagaatgccaaaccggaggggcccgagcaggccgagctgggccgcctttcccctcgagcctacactgccccgccggcctgccagccacccatggagcctgagagcctcgacctccagtccccaaccaagctcagcgccagtggggaggactccaccatcccacaggccagccggctcaataacatcgtcaacaggtccctgacaggctccccccgcagcagcagcgagagccactcaccgctctacttacacccccccaagtgcacatcctgcggctcgcagtccccacagcacgcggagatgtgcctccacaccgctgggcccacattccccgaggagatgggggagacccagtctgagtactcggattccagctgtgagaacggggccttcttttgcaatgagtgtgactgccgcttctctgaggaggcctcactcaagagacacacgctgcagacccacagtgacaaaccctacaagtgtgaccgctgccaggcctccttccgctacaagggcaacctcgccagccacaagaccgtccatacgggtgagaaaccctatcgctgtaatatctgtggagcccagttcaaccggccagccaacctgaaaactcatactcgaattcactctggagagaagccctacaaatgcgaaacctgtggtgcccgatttgtgcaagtggcccacctccgtgcccacgtgctcatccacactggagagaagccctatccctgtgaaatctgtggcacccgtttccggcaccttcagactctgaagagccacctgcgaatccacacaggagagaaaccttaccattgcgagaagtgcaacctgcatttccgtcacaaaagccagctgcgtcttcacttgcgccagaagcacggcgccatcaccaacaccaaggtacaataccgtgtgtccgccactgacctgcccccggagctccccaaagcctgctgaagcatggagtgttgatgctttccattcgagtcccttctcagaatctacccaaaggatactgtaacactttacaatgttcatcccatgatgtagtgcctctttcatccactagtgcaaatcatagcgggggtgggggtggggggcggggcgtggggactgggggccagagcagctccccgtcccccactgccataaaacattaagaaaataatattgcttcttctcctatgtgtaaggcaaaccatgtcagcaaaaagcaaaatcattttatatatcaaagtgggggagtatgcaaaagttctgacttgacttggtctgcaaaatgaggaatgtatatgtttggtggggacagatgtttcttttgtatgtaaatgtgcattcttttaaaagaagagacttccggtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacacaaaaagaacaaaaaaagctgccgaaggaaaatgtgtagttttgttctagttttcggtttgtatatacctgtacaacgtgtcctacggtgccttttttcatggaagttttcagtgatggacgagcgcgccatcccttctgaagtgtaggcagacacagggacttgaagttgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaatgttgaaaagtcaagtca

SEQ ID NO: 44 - protein, 706 aa, Canis lupus familiaris; identical to SEQ ID NO: 40

SEQ ID NO: 45 - DNA, 3296 bp, Equus caballus
  CDS (114)..(2234)
tcttagaactggggttcttagaagtggtgatgcaagaagtttctaggaaaggccggacaccaggttttaagtgaaattttggactgtgaatcaaggcattgggtgaagacaaaatgacctcgccagctgacagctgtatccagttcacccgccatgccagtgacgttcttctcaatctcaatcgcctccggagccgtgacatcttgactgatgttgtcatagtggtgagccgtgagcagtttagagcccataagacagtcctcatggcctgcagtggcttgttctacagcatcttcacagaccagttgaaatgcaaccttagtgtaatcaatctggatccagagatcaaccccgaggggttctgcatcctcctggacttcatgtacacctctcggctcaacctgcgggagggcaacatcatggctgtgatggccacagccatgtacctgcagatggagcatgtcgtggacacctgccggaagtttatcaaggccagtgaagcagagatggttcctgccatcaaacctccccgtgaagagttcctgaacagccggatgctgatgccccaagacatcatggcctatcggggtcgtgaggtgatggagaacagcctgccgctgaggaatgcccccgggtgtgagagcagagcctttgcccccagcctgtacagtggcctgtccacaccgccagcttcctatcccgtgtacagccacctcccggtcagcagcttcctcttttccgatgaggagttgcgggatgcccggatgcctgtggccaatcctttccccaaggagcggacgctcccctgcgatagtgccaggccagtccctgttgagtacagtcggccggccatggagctgtcccacagtgtgtgccacagcaacatctactctcccaaggaggcagccccagaggaggcacggagtgacatgcactacagtgtggccgagggtcccaagcctgctgctccctcggcccggaatgccccatacttcccctgtgacaaggctggcaaggaggaagagagaccctcttcggaggatgagatcgctctgcatttcgagccccccagtgcccccctgaaccggaagggtctggttagtccacagagcccccagaagtccgactgccagcccaactcgcccacggagtcctgcagcagcaagaatgcctgcatcctccagacctctggctcccctccagccaagagccccactgaccccaaagcctgcaactggaagaaatacaagttcatcgtgctcaacagcctcaaccagaatgctaaaccagaggggcccgagcaggctgagctgggccgcctctcccctcgagcctacactgcacccccagcctgccagccacccatggagcccgagaaccttgacctccagtccccaactaagctcagtgccaatggggaggactccaccatcccgcaggccagccggctcaataacatcgtcaacaggtccttgacaggctccccccgcagcagcagcgagagccactcgccactctacctgcacccccccaagtgcacgtcctgcggctctcagtccccgcagcacgcggagatgtgcctccacaccgccggccccacgttccctgaggagatgggagagacccagtctgagtactcggattccagctgtgagaatggggccttcttctgcaatgagtgtgactgccgcttctctgaggaggcctccctcaagaggcacacgctgcagacccacagtgacaaaccctacaagtgtgaccggtgccaagcctccttccgctacaagggcaacctcgccagccacaagaccgtccacacgggtgagaaaccctatcgttgtaatatctgtggggcccagttcaaccggccagccaatctgaaaacccatactcgaattcactctggagagaagccctacaaatgcgaaacctgcggagccagatttgtacaggtggcccacctccgtgcccacgtgctcatccacactggcgagaagccctatccctgtgaaatctgtggcacccgtttccggcaccttcagactctgaagagccacctgcgaatccacacgggagagaaaccttaccattgcgagaagtgtaacctgcatttccgtcacaaaagccagctgcgtcttcacttgcgccagaagcacggtgccatcaccaacaccaaggtgcaataccgcgtgtctgccactgacctgcccccggaactccccaaagcctgctgaagcatggagtgttgatgctttccattcgagccccttctcagaatctacccaaaggatactgtaacactttaagatgttcatcccatgacgtagtgcctctttcatccactagtgcaaatcatagctgagggtgggggtggggggaggggcgtggggaccgggagccaaggcagctccccttcccccactgccgtaaaacattaagaaaataatattgcttcttctcctatgtgtacggcaaaccatgtcagcaaaaagcaaaatcattttcgataccgaagttggggagtacgcaaaagttctgacttgacttagtctgcaaaatgaggaatgtatatgttttgtgggaacagatgtttcttttgtatgtaaatgtgcattcttttaaaagaagagattaatggtatgttatgaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaacgtgtagttttgttctagtttttggtttgtatatacctgtacaacgtgtcctacggtgccttttttcatggaagttttcaacgatggacgagcgcgccatccctttttgaagtgtaggcagacacagggacttgaaattgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgttgaaaagtcaa

SEQ ID NO: 46 - protein, 706 aa, Equus caballus
MTSPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREEFLNSRMLMPQDIMAYRGREVMENSLPLRNAPGCESRAFAPSLYSGLSTPPASYPVYSHLPVSSFLFSDEELRDARMPVANPFPKERTLPCDSARPVPVEYSRPAMELSHSVCHSNIYSPKEAAPEEARSDMHYSVAEGPKPAAPSARNAPYFPCDKAGKEEERPSSEDEIALHFEPPSAPLNRKGLVSPQSPQKSDCQPNSPTESCSSKNACILQTSGSPPAKSPTDPKACNWKKYKFIVLNSLNQNAKPEGPEQAELGRLSPRAYTAPPACQPPMEPENLDLQSPTKLSANGEDSTIPQASRLNNIVNRSLTGSPRSSSESHSPLYLHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 47 - DNA, 5595 bp, Equus caballus
  CDS (2413)..(4533)
ctttccaaggacagttagtgccttccatcttcattaacgtgaataaagaccttggctgacttctgtccagatcggatttttaaaggcattgtttgcttggggagatcatgccgttcccctcccctgccagcctttttgcaaaggctgaacccagtccagccaggatggccgagatatctttgcttggggacgtggtttgctggcattgtcttccggccctttctggaaggctgtcgcgagccgggcgcatggggagcgtcccttctgcagctcctcttcagatcttgatgataaaacacatccctctattttattgcatttcctagaagcttgcaggcttgcaagaacgctgttggcaggaaacgtgacagaaatgaaagtccggacataatgtcccccaacacctcggtcactcaaagcgactgccgaggccaccgcgttatcaaattcgctttcatctactgtcgtctccccaccctcccgccccccagccaagagcgctaagagtgtttcccctctagaacaaaaacaactccgcgggttgaccctactctctgctgccggaccactgtgtctagacctgagcagctagttagctgagacgctgcggagaaagggagcgctccggcaggagccctgatgtgggtttcactgcgacagctccagccttattaaaattccttctccttgcccctaaacatgctttgcactttcagattctcctttggatttctcagcgagttattggagttattagattaccaataatccaaaagctggccaggagagcgaagagaggggaagggcgggaggcgttctccaaatctggagactgtgtctaaactaggtcaatgggaaggaggggcggggcgacaagggggttgtctgtttcaagcctaggtggagggctctctctagtgttaggcagcggtaagacatgatcaggtttgagctcccggaaccatgggactcctaatttccaataagagcatttacttaattttaacttcccttcctagattctcactccttcccatattaagtttcagcctctgctttcacatttatcctacgtggtaaagggatgggaaagcctcaaaggattttatgaggcggaagaggcccagtctttatggaccggccctgaccccgcctccgccactaataggatgcgcgactcagcgtgacgccacacgccagttttaggaccggactgcggcctgagacgctgcccgtttctcgccccttaacgcctattctttggcccccgaaagcgcctgtcgtacccggctactgagacccattaggagatggcgcccagggcttataattccaaggaaggccacgggaagacgaggcaaccttggagcgcgcccgtgcgcgcgctggggtcggcgcccgggcctctgccaaatcctaatcgtgtctctacggtttcggagaaatcagattctcaaatcccgaaacctggccaggttcggcctggcagctccttattctaaagtctttgggcggaaacccagccgagctgggttccccttcgtgccaacgtaggcggaaggggctttcggtttagttttcctctaacccggctgggacgcgctgggtggagaccccagccttagggactccgtattttcgaccttgacgcctcgcctaatcactcctttaaaaagaggggatgagggccaaacaaaaagagagaaaaaggaaaaaagacacggtatgcaccaggcaaacaaacgctggaattgggcaacttgaagtcatgaaataaacctcggattggccccgaaatcctgggttctaggccggctctgctactaatttgacttctcccatttataaaattattgtggggcaagggttggactaagtgaagtgtaagagtcccggacccggcgcagacgaggtttttaggggaaagtgtgccatattccccgcgagcctccccgggcggcccccccccttctcgggtgaatccccggaggcccgcgcggcgcaggcagcgatcccggcggccgtcggggccggcagcttcctggaaagttacttctcgttggagccggcgataggcaaagagtgttctgtgaaatccgctgagctgagattgactacgttccgggaatgagagggctgtgccgttcccctcactgccccccgccttgacggcgtaacaggaaaaagaaaggcacacacaatgttagctactgaggtgcacgaaaagttttacttgaatgtaaccaaattaagggctgccacggtcataccacggggcctctgccgcgcctgcggagccttcgaggcggatgggcagcggtgcccgcagagcgcccgggggtgggcggtctctggcagacaggttttaagtgaaattttggactgtgaatcaaggcattgggtgaagacaaaatgacctcgccagctgacagctgtatccagttcacccgccatgccagtgacgttcttctcaatctcaatcgcctccggagccgtgacatcttgactgatgttgtcatagtggtgagccgtgagcagtttagagcccataagacagtcctcatggcctgcagtggcttgttctacagcatcttcacagaccagttgaaatgcaaccttagtgtaatcaatctggatccagagatcaaccccgaggggttctgcatcctcctggacttcatgtacacctctcggctcaacctgcgggagggcaacatcatggctgtgatggccacagccatgtacctgcagatggagcatgtcgtggacacctgccggaagtttatcaaggccagtgaagcagagatggttcctgccatcaaacctccccgtgaagagttcctgaacagccggatgctgatgccccaagacatcatggcctatcggggtcgtgaggtgatggagaacagcctgccgctgaggaatgcccccgggtgtgagagcagagcctttgcccccagcctgtacagtggcctgtccacaccgccagcttcctatcccgtgtacagccacctcccggtcagcagcttcctcttttccgatgaggagttgcgggatgcccggatgcctgtggccaatcctttccccaaggagcggacgctcccctgcgatagtgccaggccagtccctgttgagtacagtcggccggccatggagctgtcccacagtgtgtgccacagcaacatctactctcccaaggaggcagccccagaggaggcacggagtgacatgcactacagtgtggccgagggtcccaagcctgctgctccctcggcccggaatgccccatacttcccctgtgacaaggctggcaaggaggaagagagaccctcttcggaggatgagatcgctctgcatttcgagccccccagtgcccccctgaaccggaagggtctggttagtccacagagcccccagaagtccgactgccagcccaactcgcccacggagtcctgcagcagcaagaatgcctgcatcctccagacctctggctcccctccagccaagagccccactgaccccaaagcctgcaactggaagaaatacaagttcatcgtgctcaacagcctcaaccagaatgctaaaccagaggggcccgagcaggctgagctgggccgcctctcccctcgagcctacactgcacccccagcctgccagccacccatggagcccgagaaccttgacctccagtccccaactaagctcagtgccaatggggaggactccaccatcccgcaggccagccggctcaataacatcgtcaacaggtccttgacaggctccccccgcagcagcagcgagagccactcgccactctacctgcacccccccaagtgcacgtcctgcggctctcagtccccgcagcacgcggagatgtgcctccacaccgccggccccacgttccctgaggagatgggagagacccagtctgagtactcggattccagctgtgagaatggggccttcttctgcaatgagtgtgactgccgcttctctgaggaggcctccctcaagaggcacacgctgcagacccacagtgacaaaccctacaagtgtgaccggtgccaagcctccttccgctacaagggcaacctcgccagccacaagaccgtccacacgggtgagaaaccctatcgttgtaatatctgtggggcccagttcaaccggccagccaatctgaaaacccatactcgaattcactctggagagaagccctacaaatgcgaaacctgcggagccagatttgtacaggtggcccacctccgtgcccacgtgctcatccacactggcgagaagccctatccctgtgaaatctgtggcacccgtttccggcaccttcagactctgaagagccacctgcgaatccacacgggagagaaaccttaccattgcgagaagtgtaacctgcatttccgtcacaaaagccagctgcgtcttcacttgcgccagaagcacggtgccatcaccaacaccaaggtgcaataccgcgtgtctgccactgacctgcccccggaactccccaaagcctgctgaagcatggagtgttgatgctttccattcgagccccttctcagaatctacccaaaggatactgtaacactttaagatgttcatcccatgacgtagtgcctctttcatccactagtgcaaatcatagctgagggtgggggtggggggaggggcgtggggaccgggagccaaggcagctccccttcccccactgccgtaaaacattaagaaaataatattgcttcttctcctatgtgtacggcaaaccatgtcagcaaaaagcaaaatcattttcgataccgaagttggggagtacgcaaaagttctgacttgacttagtctgcaaaatgaggaatgtatatgttttgtgggaacagatgtttcttttgtatgtaaatgtgcattcttttaaaagaagagattaatggtatgttatgaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaacgtgtagttttgttctagtttttggtttgtatatacctgtacaacgtgtcctacggtgccttttttcatggaagttttcaacgatggacgagcgcgccatccctttttgaagtgtaggcagacacagggacttgaaattgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgttgaaaagtcaa

SEQ ID NO: 48 - protein, 706 aa, Equus caballus; identical to SEQ ID NO: 46

SEQ ID NO: 49 - DNA, 4704 bp, Equus caballus
  CDS (1522)..(3642)
tgtgatggggtgggcgaagctgcgggggcgtgctcccgggcgcacagggctcaggtttgtgcccgtgtgtgtgagcgagagaatggggctgcctagtgcccgccgattggaggagggagggaaagcatggggtcttcgtattggcttgttctcactcttaacctcgcctctcgctgttctgtgacctccacacttgtctctctccctctcgtttctgctatcttctcttctttctctttgcctttttttttttcttttgagggagaggtccctctttttccttttctaaatcctttaaaggatttgccttctcctcaaggtgcttaaatgaaaacacatacggaaagcaccaaaggagagaaagtgtgtagggtggagaagacaacgtttaactctcacttggtggttgctgcggatggggtggggttggggtcggggggtttgggatcgggggagtccgggtctgggcctttgagttgtcagtttctccttgacagctctgcttttttggttgtttttgtggaatgagtcttgtgtgtggcatgggtgggatgggtgaagctagtggacaggatttgtccagggttttgctggggattagttttgagatcctgggcaaggcttgtcggctggagcctcagtgtcctacccggtaaatcagggctgaggatcagatgcaataacggacgagaaagagctgagtggtctataaaaaacaacccaaaggcttccacacctgcagcacctagaaggaggctccattgctcacattcaccataacccacatactcactagttgtggggcctccgaagacagatctagcttaggaaggagtggacctagtaaggagaggggccttagtgtatgtgcatttgtttctggccaagccaggcagaatttagggtgataagtgcctaacccagggcctggctgacagtggacccaggggaattgttttgtttgtttgtttcattccgcatctggagtgagtcattgccacttgtcaaggtgaaatggcaaatctgagctccctgtggttgcacaagtctgtgactggaaatccacaagtgagcgggtggttgacgctggttaaagggcagccttaggtattccagaagtgtttagggatctcttctatgggggaagaggagaaagtttataaataaacccacgtgtgtcttcagcattcttttacaaaggagataatcatcgaacttcggttaggaccaattgagtgtatctctctgcccatcttgagttaggatggggagaggaggaaataggttcttttgtctttttctgtcctctcccttcccccatttcccccactcccccatccccactcacttacatgcacacactaaccttgaagcccatgagattgagtgacttgcacttgggaccacagagaaatgtcagagtgtttggttacagactcaaggaaacttctcattttagagtgctcatttggttttaagtgaaattttggactgtgaatcaaggcattgggtgaagacaaaatgacctcgccagctgacagctgtatccagttcacccgccatgccagtgacgttcttctcaatctcaatcgcctccggagccgtgacatcttgactgatgttgtcatagtggtgagccgtgagcagtttagagcccataagacagtcctcatggcctgcagtggcttgttctacagcatcttcacagaccagttgaaatgcaaccttagtgtaatcaatctggatccagagatcaaccccgaggggttctgcatcctcctggacttcatgtacacctctcggctcaacctgcgggagggcaacatcatggctgtgatggccacagccatgtacctgcagatggagcatgtcgtggacacctgccggaagtttatcaaggccagtgaagcagagatggttcctgccatcaaacctccccgtgaagagttcctgaacagccggatgctgatgccccaagacatcatggcctatcggggtcgtgaggtgatggagaacagcctgccgctgaggaatgcccccgggtgtgagagcagagcctttgcccccagcctgtacagtggcctgtccacaccgccagcttcctatcccgtgtacagccacctcccggtcagcagcttcctcttttccgatgaggagttgcgggatgcccggatgcctgtggccaatcctttccccaaggagcggacgctcccctgcgatagtgccaggccagtccctgttgagtacagtcggccggccatggagctgtcccacagtgtgtgccacagcaacatctactctcccaaggaggcagccccagaggaggcacggagtgacatgcactacagtgtggccgagggtcccaagcctgctgctccctcggcccggaatgccccatacttcccctgtgacaaggctggcaaggaggaagagagaccctcttcggaggatgagatcgctctgcatttcgagccccccagtgcccccctgaaccggaagggtctggttagtccacagagcccccagaagtccgactgccagcccaactcgcccacggagtcctgcagcagcaagaatgcctgcatcctccagacctctggctcccctccagccaagagccccactgaccccaaagcctgcaactggaagaaatacaagttcatcgtgctcaacagcctcaaccagaatgctaaaccagaggggcccgagcaggctgagctgggccgcctctcccctcgagcctacactgcacccccagcctgccagccacccatggagcccgagaaccttgacctccagtccccaactaagctcagtgccaatggggaggactccaccatcccgcaggccagccggctcaataacatcgtcaacaggtccttgacaggctccccccgcagcagcagcgagagccactcgccactctacctgcacccccccaagtgcacgtcctgcggctctcagtccccgcagcacgcggagatgtgcctccacaccgccggccccacgttccctgaggagatgggagagacccagtctgagtactcggattccagctgtgagaatggggccttcttctgcaatgagtgtgactgccgcttctctgaggaggcctccctcaagaggcacacgctgcagacccacagtgacaaaccctacaagtgtgaccggtgccaagcctccttccgctacaagggcaacctcgccagccacaagaccgtccacacgggtgagaaaccctatcgttgtaatatctgtggggcccagttcaaccggccagccaatctgaaaacccatactcgaattcactctggagagaagccctacaaatgcgaaacctgcggagccagatttgtacaggtggcccacctccgtgcccacgtgctcatccacactggcgagaagccctatccctgtgaaatctgtggcacccgtttccggcaccttcagactctgaagagccacctgcgaatccacacgggagagaaaccttaccattgcgagaagtgtaacctgcatttccgtcacaaaagccagctgcgtcttcacttgcgccagaagcacggtgccatcaccaacaccaaggtgcaataccgcgtgtctgccactgacctgcccccggaactccccaaagcctgctgaagcatggagtgttgatgctttccattcgagccccttctcagaatctacccaaaggatactgtaacactttaagatgttcatcccatgacgtagtgcctctttcatccactagtgcaaatcatagctgagggtgggggtggggggaggggcgtggggaccgggagccaaggcagctccccttcccccactgccgtaaaacattaagaaaataatattgcttcttctcctatgtgtacggcaaaccatgtcagcaaaaagcaaaatcattttcgataccgaagttggggagtacgcaaaagttctgacttgacttagtctgcaaaatgaggaatgtatatgttttgtgggaacagatgtttcttttgtatgtaaatgtgcattcttttaaaagaagagattaatggtatgttatgaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaacgtgtagttttgttctagtttttggtttgtatatacctgtacaacgtgtcctacggtgccttttttcatggaagttttcaacgatggacgagcgcgccatccctttttgaagtgtaggcagacacagggacttgaaattgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgttgaaaagtcaa

SEQ ID NO: 50 - protein, 706 aa, Equus caballus; identical to SEQ ID NO: 46

SEQ ID NO: 51 - DNA, 6462 bp, Felis catus
  CDS (3265)..(5385)
ccccccgccccaaacagtgcgttgcactttcagattctcctttggatttctcagagagttattggtgttattagattaccaataatccaaaggccggccgggatagagaaaggtgggggtggggtggggatgtgaaaggcattctccgaatctggagcctgtgtctaaagtaggtcaatgggaaggagaggcggggctacatggatattgtcggtttctagccttgatggagggctctctctagtgtcaggcagcggtaaaacatgattaggttttagctcccggaaccacgggactcctaatttccaataagtgcatgtacttaattttaacttcccttcctagatactcaccccattccatattaaatttcaaccttcgctttcacctttattccaccgggcgaagggatgagaaagcctccaagtaagattttatgaggcggacgaggcccagtctttacctaccgcccggaccccgcctccgccgctgatgggatgcgcgacgcagtgagagaccacccgcgggttttaggagaggactatggcctcaggggctacgtctttcgtgcccctcgccccggaaaattactctcggagcccactactaggaccaattaggagagggcgcccaggggttataattccgaggaaggccatgagaacgctaggcaatccaggagctcgcccatgcgcgcgctggggtcagcgccccggtccctgcgcaatcctaaccgcgtctctacgtgtttcggagaaatcggattccgaaatcccgaaacctagccaggtttggcctggcagctcctattctaaagactttgggcggaaaccgagctgagcagggttcccctacttgccaacgtaggcggaaggggctttcggtttggttttgctccaggtcggctggtgcgcactggctggagaccctcagtcctagggactcccatctttctactttgacgcctggcctataaccagccccttaaggggagggggggggtggagcaagcaaaaagagagaaagggaaaaaaaaaagagagaaaaataaataaataaatgacgcaccaggcaaacaaacacgagaattaggcaattctaagtcctgaaatgagtttcggattggacccgaattcctgggttctggaccggctctgctactcacttgcgcgactttccccatgtataaaatttttgtgggggaagggttggaccgcgtgaactcagaatcctggatcgggcgccggcgagggatttaggggaaagtgtgcctattccccgcgagcctccctgggcggccccccctccccgggtgaatccccggcggccctcgcgccgcaggcagcgatcctggcggccgtcgggggccggcagcttcctggaaagttacttctcgttggaaacggcgataggcagagagtgttctgtgaaatccgctgagctgagatcgactatgttccgggaatgagagggctgtgccattcccctcactgcccactgccttgacggcgtaacaggaaaaaaaaaaaaaaaaaaaaaggcacacacaatgttagctaccgaagtgtacgaaacgttttatttgaatgtaaccaaattaaaggttgccacgatctcaccacggggcctccgacgcgcctgcgggggcttcgaggcagatgggccgcggcgcccgcagaacgcccgggggtgggcggtccctggcgggcaggtacggtaaggtaggggtgggcgcatctgcccgggcttgctgtggcgcgcagggctccggtttgtgcccgtgtgagcctgtgagaggaagcgcagtgcccgccgagcgggagagacagggaaagggtgaatggggggctttcgtgttggctcactctctctctcttaacctggccctcgttcttttctgccctcctctcttgtctctccgccttctccttcggctgccttctcttccctctctgccttttgtacagggagagggtccctcgtttttcttctccagctcctctgaaagatctgccttctcctcaaggtgccgaattgaaaatcccgagggaaaaggcagaggagagaaagtgtgtgggtggaaagacaatatttaggtctcacttcgtggttactgcggctggggcggggtaggggtggggggagcccacgtctgggcccttgcagttgtcagtttctctttgacagccctgttcttttggcggttgtttctgtgtaatgagtattgtgtgtggcgtccatgggattccggctgaagcttagtaagacagagtttgtccaggactttgctggagattagctttcagtcttgggcaaggcttatcccatgaagcgtcggtggcctccccagtaaatcagggctgttataaagatcacagacgatgatggatggggaaggcctgagtggtctgtaggaaacaaagcagctgctaggggtccttccacacttgcggcaaatagagggaggcatggcttcccacatccaccttaacacgcactcactagctgtgaggtcccctaagatagacccagctgaagaagaggtgggcttaataaggatgagcctcagtgtgtgtgcgtttgtttttgaccaagccaggcagaggtttaggatgaaaagtgcccagccccagggcctggctggcagacccacccccacccccaccccacccgcagggggcaggaggtgggaacgtgttgtttgtttgcttcgatctgcatatggagtgagtcattgccacttgtcaaggtgaaatggcagatctgggcttcctgtggttccaaaaatctgtgagtggaaatccacaagcgagctggtggttgaagctggctaaaggagagccttagatattccagaagtgttcagggatgttttgcaccgggggaagagaagacggtttgtaaatgaacctctcacgccgcgtctccagtgttcttttttcaacagagacaatcattgaactttggttaggacagttcagtgtatttctctttgcccgtcttgagttaggatggggagaggaggaaataggttctttcctctccttcttttcctctcccttccccactcccttcccttatcctcactcactcacatgcacacactaaccttgaagccgatgggattgagtgactggcacttgggaccacagagaaatgtcagagtgtttggttacagactcaaggaaacctctcattttagagtgctcatttgattttaagcaacattttggactgtgaatcaaggcattgggtgaagacaaaatggcctcgccggctgacagctgtatccagttcactcgccatgccagcgacgtgcttctcaaccttaaccgcctgcggagccgtgacatcttgaccgatgttgtcatcgtggtgagccgcgagcagttcagagcccataagacagtcctcatggcctgcagcggcctgttctatagcatcttcacagaccagttgaaatgtaacctgagcgtgatcaacctggatcctgagatcaaccccgaggggttctgcatcctcctggacttcatgtacacgtctcggctcaatctgcgggagggcaacatcatggccgtgatggctacggctatgtacctgcagatggagcacgttgtggacacttgccggaagtttatcaaggccagtgaagccgagatggttcctgccatcaagcctccccgtgacgagtttctgaatagccggatgctgatgccccaagacatcatggcctatcggggtcgtgaggtgatggagaataacctgccgctgaggaacgcccctgggtgtgagagcagggcgtttgcccccagcctgtacagcggcctgtccaccccgccagcctcttaccccgtgtacagccacctcccggtcagcagcttcctcttctccgatgaggagctgcgggatgcccggatgcccgtggccaaccccttccccaaggagcgggccctcccctgtgatagtgccaggcccgtacccggcgagtacagccggccggccatggagatgccccccagtgtgtgccacagcagcatctactcgcccaaggaggccgccccggaggaggcacgcagtgacatgcactacggcgtggccgagggccccaagccggccgccccctcggcccggaatgccccatacttcccctgtgacaaggccggcaaggaggaagagaggccctcctccgaggatgagatcgccctgcatttcgagccccccagtgcacccctgaaccggaagggtctggtgagtccgcagagcccgcagaagtctgactgccagcccaactcgcccacggagtcctgcagcagcaagaacgcctgcattctccagacctccggttcgccgccggccaagagccccaccgaccccaaagcctgcaactggaagaagtacaagttcattgtgctcaacagcctcaaccagaatgccaaaccagaggggcccgagcaggcggagctgggccgcctttcccctcgagcctacacggccccgccggcctgccagccgcccatggagcccgagagccttgacctccagtccccaaccaagcttagcgccagcggggaggactccaccatcccacaggccagccggctcaataacatcgtcaacaggtccctgaccggctccccccgcagcagcagcgagagccactcgcctctctacttgcacccccccaagtgcacatcctgcggctctcagtccccgcagcacgcggagatgtgcctccacaccgccggccccacattccccgaggagatgggagagacccagtctgagtactcggattccagctgtgagaacggggccttcttctgtaacgagtgtgactgccgcttctctgaggaggcctcgctcaagagacacacgctgcagacccacagcgacaaaccctacaagtgtgaccgctgccaggcctctttccgctacaagggcaacctcgccagccacaagactgtgcatacgggtgagaaaccctatcgctgtaacatctgtggagcccagttcaaccggccagccaacctgaaaacccatactcgaatccactctggagagaagccctacaaatgcgaaacctgtggagccagattcgtacaagtggcccacctccgtgcccacgtgctcatccacactggagagaagccctatccctgtgaaatctgtggcacccgtttccggcaccttcagactctgaagagccacttgcgaatccacacgggagagaaaccttaccattgcgagaagtgtaacctgcatttccgtcacaaaagccagctgcgtcttcacttgcgccagaagcacggcgccatcaccaacaccaaggtgcagtaccgtgtgtccgccactgacctgcccccggagctccccaaggcctgctgaagcatggagtgttgatgctttccattcgagtcccttctcagaaatctacccaaaggatactgtaacactttacgatgctcatcccatgacgtagtgcctctttcatccactagtgcaaatcatagctgggctggggtgggggggaggggcggggggaccgggagccaaggcagctccccttcccctactgccataaaacattaagaaaataatattgcttcttctcctatgtgtaaggcaaaccacgtcagcaaacggcaaaatcattttatatatcagagcggggggagtatgcaaaagttctgacttgacttggtctgcaaaatgaggaatgtatatgttttgtgggaacagctgtttcttttgtatgtaaatgtgcattcttttaaaagaagagacttcggtatgttatcaaagagagggctttaatttttttaaccaaaggtgaaggaatatatggcagagttgtaaatatataaatatatatatatataaaataaatatatataaacctaaaaaagatatattaaaaatataaaactgtgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaccaacaaaaagaacaaaaaaagctaccgaaggaaaaatgtgtagttttgttctagttctcggtttgtatatacccgtacaacgtgtcctacggtgccttttttcatggaagttttcagtgatggacgagcacgccatcccttctgaggtgtaggcagacacagggacttgaagtcgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaacgttgaaaagtcaa

SEQ ID NO: 52 - protein, 706 aa, Felis catus
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPRDEFLNSRMLMPQDIMAYRGREVMENNLPLRNAPGCESRAFAPSLYSGLSTPPASYPVYSHLPVSSFLFSDEELRDARMPVANPFPKERALPCDSARPVPGEYSRPAMEMPPSVCHSSIYSPKEAAPEEARSDMHYGVAEGPKPAAPSARNAPYFPCDKAGKEEERPSSEDEIALHFEPPSAPLNRKGLVSPQSPQKSDCQPNSPTESCSSKNACILQTSGSPPAKSPTDPKACNWKKYKFIVLNSLNQNAKPEGPEQAELGRLSPRAYTAPPACQPPMEPESLDLQSPTKLSASGEDSTIPQASRLNNIVNRSLTGSPRSSSESHSPLYLHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 53 - DNA, 3336 bp, Felis catus
  CDS (139)..(2259)
attccgagaattgagctctgttgattcttagaactggggttcttagaagtggtgatgcaagaagtttctaggaaaggccggacaccagattttaagcaacattttggactgtgaatcaaggcattgggtgaagacaaaatggcctcgccggctgacagctgtatccagttcactcgccatgccagcgacgtgcttctcaaccttaaccgcctgcggagccgtgacatcttgaccgatgttgtcatcgtggtgagccgcgagcagttcagagcccataagacagtcctcatggcctgcagcggcctgttctatagcatcttcacagaccagttgaaatgtaacctgagcgtgatcaacctggatcctgagatcaaccccgaggggttctgcatcctcctggacttcatgtacacgtctcggctcaatctgcgggagggcaacatcatggccgtgatggctacggctatgtacctgcagatggagcacgttgtggacacttgccggaagtttatcaaggccagtgaagccgagatggttcctgccatcaagcctccccgtgacgagtttctgaatagccggatgctgatgccccaagacatcatggcctatcggggtcgtgaggtgatggagaataacctgccgctgaggaacgcccctgggtgtgagagcagggcgtttgcccccagcctgtacagcggcctgtccaccccgccagcctcttaccccgtgtacagccacctcccggtcagcagcttcctcttctccgatgaggagctgcgggatgcccggatgcccgtggccaaccccttccccaaggagcgggccctcccctgtgatagtgccaggcccgtacccggcgagtacagccggccggccatggagatgccccccagtgtgtgccacagcagcatctactcgcccaaggaggccgccccggaggaggcacgcagtgacatgcactacggcgtggccgagggccccaagccggccgccccctcggcccggaatgccccatacttcccctgtgacaaggccggcaaggaggaagagaggccctcctccgaggatgagatcgccctgcatttcgagccccccagtgcacccctgaaccggaagggtctggtgagtccgcagagcccgcagaagtctgactgccagcccaactcgcccacggagtcctgcagcagcaagaacgcctgcattctccagacctccggttcgccgccggccaagagccccaccgaccccaaagcctgcaactggaagaagtacaagttcattgtgctcaacagcctcaaccagaatgccaaaccagaggggcccgagcaggcggagctgggccgcctttcccctcgagcctacacggccccgccggcctgccagccgcccatggagcccgagagccttgacctccagtccccaaccaagcttagcgccagcggggaggactccaccatcccacaggccagccggctcaataacatcgtcaacaggtccctgaccggctccccccgcagcagcagcgagagccactcgcctctctacttgcacccccccaagtgcacatcctgcggctctcagtccccgcagcacgcggagatgtgcctccacaccgccggccccacattccccgaggagatgggagagacccagtctgagtactcggattccagctgtgagaacggggccttcttctgtaacgagtgtgactgccgcttctctgaggaggcctcgctcaagagacacacgctgcagacccacagcgacaaaccctacaagtgtgaccgctgccaggcctctttccgctacaagggcaacctcgccagccacaagactgtgcatacgggtgagaaaccctatcgctgtaacatctgtggagcccagttcaaccggccagccaacctgaaaacccatactcgaatccactctggagagaagccctacaaatgcgaaacctgtggagccagattcgtacaagtggcccacctccgtgcccacgtgctcatccacactggagagaagccctatccctgtgaaatctgtggcacccgtttccggcaccttcagactctgaagagccacttgcgaatccacacgggagagaaaccttaccattgcgagaagtgtaacctgcatttccgtcacaaaagccagctgcgtcttcacttgcgccagaagcacggcgccatcaccaacaccaaggtgcagtaccgtgtgtccgccactgacctgcccccggagctccccaaggcctgctgaagcatggagtgttgatgctttccattcgagtcccttctcagaaatctacccaaaggatactgtaacactttacgatgctcatcccatgacgtagtgcctctttcatccactagtgcaaatcatagctgggctggggtgggggggaggggcggggggaccgggagccaaggcagctccccttcccctactgccataaaacattaagaaaataatattgcttcttctcctatgtgtaaggcaaaccacgtcagcaaacggcaaaatcattttatatatcagagcggggggagtatgcaaaagttctgacttgacttggtctgcaaaatgaggaatgtatatgttttgtgggaacagctgtttcttttgtatgtaaatgtgcattcttttaaaagaagagacttcggtatgttatcaaagagagggctttaatttttttaaccaaaggtgaaggaatatatggcagagttgtaaatatataaatatatatatatataaaataaatatatataaacctaaaaaagatatattaaaaatataaaactgtgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaccaacaaaaagaacaaaaaaagctaccgaaggaaaaatgtgtagttttgttctagttctcggtttgtatatacccgtacaacgtgtcctacggtgccttttttcatggaagttttcagtgatggacgagcacgccatcccttctgaggtgtaggcagacacagggacttgaagtcgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaacgttgaaaagtcaa

SEQ ID NO: 54 - protein, 706 aa, Felis catus; identical to SEQ ID NO: 52

SEQ ID NO: 55 - DNA, 4959 bp, Felis catus
  CDS (1762)..(3882)
ccccccgccccaaacagtgcgttgcactttcagattctcctttggatttctcagagagttattggtgttattagattaccaataatccaaaggccggccgggatagagaaaggtgggggtggggtggggatgtgaaaggcattctccgaatctggagcctgtgtctaaagtaggtcaatgggaaggagaggcggggctacatggatattgtcggtttctagccttgatggagggctctctctagtgtcaggcagcggtaaaacatgattaggttttagctcccggaaccacgggactcctaatttccaataagtgcatgtacttaattttaacttcccttcctagatactcaccccattccatattaaatttcaaccttcgctttcacctttattccaccgggcgaagggatgagaaagcctccaagtaagattttatgaggcggacgaggcccagtctttacctaccgcccggaccccgcctccgccgctgatgggatgcgcgacgcagtgagagaccacccgcgggttttaggagaggactatggcctcaggggctacgtctttcgtgcccctcgccccggaaaattactctcggagcccactactaggaccaattaggagagggcgcccaggggttataattccgaggaaggccatgagaacgctaggcaatccaggagctcgcccatgcgcgcgctggggtcagcgccccggtccctgcgcaatcctaaccgcgtctctacgtgtttcggagaaatcggattccgaaatcccgaaacctagccaggtttggcctggcagctcctattctaaagactttgggcggaaaccgagctgagcagggttcccctacttgccaacgtaggcggaaggggctttcggtttggttttgctccaggtcggctggtgcgcactggctggagaccctcagtcctagggactcccatctttctactttgacgcctggcctataaccagccccttaaggggagggggggggtggagcaagcaaaaagagagaaagggaaaaaaaaaagagagaaaaataaataaataaatgacgcaccaggcaaacaaacacgagaattaggcaattctaagtcctgaaatgagtttcggattggacccgaattcctgggttctggaccggctctgctactcacttgcgcgactttccccatgtataaaatttttgtgggggaagggttggaccgcgtgaactcagaatcctggatcgggcgccggcgagggatttaggggaaagtgtgcctattccccgcgagcctccctgggcggccccccctccccgggtgaatccccggcggccctcgcgccgcaggcagcgatcctggcggccgtcgggggccggcagcttcctggaaagttacttctcgttggaaacggcgataggcagagagtgttctgtgaaatccgctgagctgagatcgactatgttccgggaatgagagggctgtgccattcccctcactgcccactgccttgacggcgtaacaggaaaaaaaaaaaaaaaaaaaaaggcacacacaatgttagctaccgaagtgtacgaaacgttttatttgaatgtaaccaaattaaaggttgccacgatctcaccacggggcctccgacgcgcctgcgggggcttcgaggcagatgggccgcggcgcccgcagaacgcccgggggtgggcggtccctggcgggcagattttaagcaacattttggactgtgaatcaaggcattgggtgaagacaaaatggcctcgccggctgacagctgtatccagttcactcgccatgccagcgacgtgcttctcaaccttaaccgcctgcggagccgtgacatcttgaccgatgttgtcatcgtggtgagccgcgagcagttcagagcccataagacagtcctcatggcctgcagcggcctgttctatagcatcttcacagaccagttgaaatgtaacctgagcgtgatcaacctggatcctgagatcaaccccgaggggttctgcatcctcctggacttcatgtacacgtctcggctcaatctgcgggagggcaacatcatggccgtgatggctacggctatgtacctgcagatggagcacgttgtggacacttgccggaagtttatcaaggccagtgaagccgagatggttcctgccatcaagcctccccgtgacgagtttctgaatagccggatgctgatgccccaagacatcatggcctatcggggtcgtgaggtgatggagaataacctgccgctgaggaacgcccctgggtgtgagagcagggcgtttgcccccagcctgtacagcggcctgtccaccccgccagcctcttaccccgtgtacagccacctcccggtcagcagcttcctcttctccgatgaggagctgcgggatgcccggatgcccgtggccaaccccttccccaaggagcgggccctcccctgtgatagtgccaggcccgtacccggcgagtacagccggccggccatggagatgccccccagtgtgtgccacagcagcatctactcgcccaaggaggccgccccggaggaggcacgcagtgacatgcactacggcgtggccgagggccccaagccggccgccccctcggcccggaatgccccatacttcccctgtgacaaggccggcaaggaggaagagaggccctcctccgaggatgagatcgccctgcatttcgagccccccagtgcacccctgaaccggaagggtctggtgagtccgcagagcccgcagaagtctgactgccagcccaactcgcccacggagtcctgcagcagcaagaacgcctgcattctccagacctccggttcgccgccggccaagagccccaccgaccccaaagcctgcaactggaagaagtacaagttcattgtgctcaacagcctcaaccagaatgccaaaccagaggggcccgagcaggcggagctgggccgcctttcccctcgagcctacacggccccgccggcctgccagccgcccatggagcccgagagccttgacctccagtccccaaccaagcttagcgccagcggggaggactccaccatcccacaggccagccggctcaataacatcgtcaacaggtccctgaccggctccccccgcagcagcagcgagagccactcgcctctctacttgcacccccccaagtgcacatcctgcggctctcagtccccgcagcacgcggagatgtgcctccacaccgccggccccacattccccgaggagatgggagagacccagtctgagtactcggattccagctgtgagaacggggccttcttctgtaacgagtgtgactgccgcttctctgaggaggcctcgctcaagagacacacgctgcagacccacagcgacaaaccctacaagtgtgaccgctgccaggcctctttccgctacaagggcaacctcgccagccacaagactgtgcatacgggtgagaaaccctatcgctgtaacatctgtggagcccagttcaaccggccagccaacctgaaaacccatactcgaatccactctggagagaagccctacaaatgcgaaacctgtggagccagattcgtacaagtggcccacctccgtgcccacgtgctcatccacactggagagaagccctatccctgtgaaatctgtggcacccgtttccggcaccttcagactctgaagagccacttgcgaatccacacgggagagaaaccttaccattgcgagaagtgtaacctgcatttccgtcacaaaagccagctgcgtcttcacttgcgccagaagcacggcgccatcaccaacaccaaggtgcagtaccgtgtgtccgccactgacctgcccccggagctccccaaggcctgctgaagcatggagtgttgatgctttccattcgagtcccttctcagaaatctacccaaaggatactgtaacactttacgatgctcatcccatgacgtagtgcctctttcatccactagtgcaaatcatagctgggctggggtgggggggaggggcggggggaccgggagccaaggcagctccccttcccctactgccataaaacattaagaaaataatattgcttcttctcctatgtgtaaggcaaaccacgtcagcaaacggcaaaatcattttatatatcagagcggggggagtatgcaaaagttctgacttgacttggtctgcaaaatgaggaatgtatatgttttgtgggaacagctgtttcttttgtatgtaaatgtgcattcttttaaaagaagagacttcggtatgttatcaaagagagggctttaatttttttaaccaaaggtgaaggaatatatggcagagttgtaaatatataaatatatatatatataaaataaatatatataaacctaaaaaagatatattaaaaatataaaactgtgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaccaacaaaaagaacaaaaaaagctaccgaaggaaaaatgtgtagttttgttctagttctcggtttgtatatacccgtacaacgtgtcctacggtgccttttttcatggaagttttcagtgatggacgagcacgccatcccttctgaggtgtaggcagacacagggacttgaagtcgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaacgttgaaaagtcaa

SEQ ID NO: 56 - protein, 706 aa, Felis catus; identical to SEQ ID NO: 52

SEQ ID NO: 57 - DNA, 3279 bp, Bos taurus
  CDS (85)..(2205)
ctcaaggaaacctctcattttagagtgctcatttggttttaagcaaaattttggactgtgaatcaaggcactgggtgaagaaaaatggcctcgccggctgacagctgtatccagttcacccgccatgccagtgacgttcttctcaaccttaatcgactccggagccgtgacatcttgactgatgttgtcatagtggtgagccgggagcagtttagagcccataagacagtcctcatggcctgcagtggcctgttctacagcatcttcacagaccagttgaaatgcaacctcagtgtgatcaatctggatcctgagatcaacccggaggggttctgcatcctcctggacttcatgtacacatctcggctcaatctgcgggagggcaacatcatggccgtgatggccacagctatgtaccttcagatggagcatgttgtggacacttgccggaagttcatcaaggccagtgaagcagagatggttcctgccatcaagcctccccgtgaagacttcctcaacagccgcatgctgatgccccaggacatcatggcctatcggggccgggaggtggtggagaacagcctgccactgaggaacgcccccggatgtgagagcagagcttttgcccccagcttgtacaatggcctgtccacaccgccagcctcataccctgtgtacggccaccttccggtcagcagcttccttttctctgatgaggagctccgggatgcccggatgcctatagccaaccccttccccaaggatcgggccctcccctgcgacagtgccaggccagtgcccagtgagtacagtcggccggccatggagatctcccccagcgtgtgccacagcaccatctactcgcccaaggaggcggctcctgaggaggcgcggagtgacatgcactacagtgtggccgagggccccaagcctgctgcgccctcagcccggagcgccccatacttcccctgtgataaggccggcaaggaggaagagcggccctcctcggaagatgagattgccctgcatttcgagccccccaatgcacccctgaacaggaagggtctggttagcccacaaagtccccagaagtctgactgccagcccaactcccctacggagtcctgtagcagcaagaacgcctgcatcctccagacctctgggtccccgccggccaagagccccactgaccccaaagcctgcaactggaagaagtacaagttcatcgtgctcaacagtctcaaccagaacgccaaaccggaggggcctgagcaggcagagctgggccgcctttccccccgagcctatgctgccccgccagcctgccagccacccatggagcctgatagccttgacctccagtccccaactaagctcagcaccagtgcggaggactccaccatcccacaggccagtcggctcaacaacattgtcaacaggtccctgactggctcccccagaagcagcagcgagagccactcgccgctctacctgcacccccccaagtgcacatcctgcggctcgcagtccccgcagcacgcagagatgtgcctgcatgctgctggccccacgttccccgaggagctgggagagacccagtctgagtactcagattccagctgcgagaatggggccttcttctgcaatgagtgtgactgccgcttttctgaggaggcttccctcaagaggcacacgctgcagacccacagtgacaaaccctacaagtgtgaccgctgccaggcctccttccgctacaagggcaacctcgccagccacaagaccgtccacacgggtgagaaaccctatcgttgtaacatttgcggggcccagttcaaccgaccggccaacctgaaaacccacacccgaattcactctggagagaagccctacaaatgcgaaacgtgcggagccagatttgtccaggtggcccacctccgtgcccatgtgctcatccacactggcgagaagccctatccctgtgaaatctgtggcacccgattccggcaccttcagactctgaagagccacctgcgaatccacacaggagagaaaccttaccattgtgagaagtgtaacctgcatttccgtcacaaaagtcagctccgtcttcacttgcgccagaagcacggcgccatcaccaacaccaaggtgcaatatcgcgtgtccgccactgacctgcccccggagctccccaaagcctgctgaagcatggagtgttgatgctttccattcgagccccttttcggaatctacccaaaggatactgtaacactttacaatgttcatcccatgatgtagtgcctctttcatccactagcgcaaatcctagctggcgggggcggggtggggggaggggcgggggacggggcgccagggcagctccccttcccccactgccgtaaaactttaagaaaataatattgcttcttctcctatgtgtacggcgaaccatgtcagcaaaaagcaaaatcattttatatatcaaagcgggggaagtacgcaaaagttctgacttgacttagtctgcaaaatgaggaatgtatatgttttgtgggatcagatgtttcttttgtatgtaaatgtgcattcttttaaaagaagagacttcggtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagactattttaagtattgcatctgtataagtaagaaaatattttgtctaaaatgcctcagtgtatttgtatttttttgcaagtgaaggtttacaatttacaaagtgtgtattaaaacaaacaaacaaaaagaacaaaaaaagctgcggaaggagaaaacgtgtagttttgttctagttttcggtttgtatatacccgtacaacgtgtcctacggtgccttttttcatggaagttttcaacaggggacgactgcgccatcccttttggacgtgtaggcagacacagggacttggagttgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgaaaagtcaaatcgg

SEQ ID NO: 58 - protein, 706 aa, Bos taurus
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREDFLNSRMLMPQDIMAYRGREVVENSLPLRNAPGCESRAFAPSLYNGLSTPPASYPVYGHLPVSSFLFSDEELRDARMPIANPFPKDRALPCDSARPVPSEYSRPAMEISPSVCHSTIYSPKEAAPEEARSDMHYSVAEGPKPAAPSARSAPYFPCDKAGKEEERPSSEDEIALHFEPPNAPLNRKGLVSPQSPQKSDCQPNSPTESCSSKNACILQTSGSPPAKSPTDPKACNWKKYKFIVLNSLNQNAKPEGPEQAELGRLSPRAYAAPPACQPPMEPDSLDLQSPTKLSTSAEDSTIPQASRLNNIVNRSLTGSPRSSSESHSPLYLHPPKCTSCGSQSPQHAEMCLHAAGPTFPEELGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 59 - DNA, 3340 bp, Bos taurus
  CDS (135)..(2255)
ccgagaattgagctctgttgattcttagaactggggttcttagaagtggtgatgcaagaagtttctaggaaaggccggacaccaggttttaagcaaaattttggactgtgaatcaaggcactgggtgaagaaaaatggcctcgccggctgacagctgtatccagttcacccgccatgccagtgacgttcttctcaaccttaatcgactccggagccgtgacatcttgactgatgttgtcatagtggtgagccgggagcagtttagagcccataagacagtcctcatggcctgcagtggcctgttctacagcatcttcacagaccagttgaaatgcaacctcagtgtgatcaatctggatcctgagatcaacccggaggggttctgcatcctcctggacttcatgtacacatctcggctcaatctgcgggagggcaacatcatggccgtgatggccacagctatgtaccttcagatggagcatgttgtggacacttgccggaagttcatcaaggccagtgaagcagagatggttcctgccatcaagcctccccgtgaagacttcctcaacagccgcatgctgatgccccaggacatcatggcctatcggggccgggaggtggtggagaacagcctgccactgaggaacgcccccggatgtgagagcagagcttttgcccccagcttgtacaatggcctgtccacaccgccagcctcataccctgtgtacggccaccttccggtcagcagcttccttttctctgatgaggagctccgggatgcccggatgcctatagccaaccccttccccaaggatcgggccctcccctgcgacagtgccaggccagtgcccagtgagtacagtcggccggccatggagatctcccccagcgtgtgccacagcaccatctactcgcccaaggaggcggctcctgaggaggcgcggagtgacatgcactacagtgtggccgagggccccaagcctgctgcgccctcagcccggagcgccccatacttcccctgtgataaggccggcaaggaggaagagcggccctcctcggaagatgagattgccctgcatttcgagccccccaatgcacccctgaacaggaagggtctggttagcccacaaagtccccagaagtctgactgccagcccaactcccctacggagtcctgtagcagcaagaacgcctgcatcctccagacctctgggtccccgccggccaagagccccactgaccccaaagcctgcaactggaagaagtacaagttcatcgtgctcaacagtctcaaccagaacgccaaaccggaggggcctgagcaggcagagctgggccgcctttccccccgagcctatgctgccccgccagcctgccagccacccatggagcctgatagccttgacctccagtccccaactaagctcagcaccagtgcggaggactccaccatcccacaggccagtcggctcaacaacattgtcaacaggtccctgactggctcccccagaagcagcagcgagagccactcgccgctctacctgcacccccccaagtgcacatcctgcggctcgcagtccccgcagcacgcagagatgtgcctgcatgctgctggccccacgttccccgaggagctgggagagacccagtctgagtactcagattccagctgcgagaatggggccttcttctgcaatgagtgtgactgccgcttttctgaggaggcttccctcaagaggcacacgctgcagacccacagtgacaaaccctacaagtgtgaccgctgccaggcctccttccgctacaagggcaacctcgccagccacaagaccgtccacacgggtgagaaaccctatcgttgtaacatttgcggggcccagttcaaccgaccggccaacctgaaaacccacacccgaattcactctggagagaagccctacaaatgcgaaacgtgcggagccagatttgtccaggtggcccacctccgtgcccatgtgctcatccacactggcgagaagccctatccctgtgaaatctgtggcacccgattccggcaccttcagactctgaagagccacctgcgaatccacacaggagagaaaccttaccattgtgagaagtgtaacctgcatttccgtcacaaaagtcagctccgtcttcacttgcgccagaagcacggcgccatcaccaacaccaaggtgcaatatcgcgtgtccgccactgacctgcccccggagctccccaaagcctgctgaagcatggagtgttgatgctttccattcgagccccttttcggaatctacccaaaggatactgtaacactttacaatgttcatcccatgatgtagtgcctctttcatccactagcgcaaatcctagctggcgggggcggggtggggggaggggcgggggacggggcgccagggcagctccccttcccccactgccgtaaaactttaagaaaataatattgcttcttctcctatgtgtacggcgaaccatgtcagcaaaaagcaaaatcattttatatatcaaagcgggggaagtacgcaaaagttctgacttgacttagtctgcaaaatgaggaatgtatatgttttgtgggatcagatgtttcttttgtatgtaaatgtgcattcttttaaaagaagagacttcggtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagactattttaagtattgcatctgtataagtaagaaaatattttgtctaaaatgcctcagtgtatttgtatttttttgcaagtgaaggtttacaatttacaaagtgtgtattaaaacaaacaaacaaaaagaacaaaaaaagctgcggaaggagaaaacgtgtagttttgttctagttttcggtttgtatatacccgtacaacgtgtcctacggtgccttttttcatggaagttttcaacaggggacgactgcgccatcccttttggacgtgtaggcagacacagggacttggagttgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgaaaagtcaaatcggtttgttctgga

SEQ ID NO: 60 - protein, 706 aa, Bos taurus; identical to SEQ ID NO: 58

SEQ ID NO: 61 - DNA, 3389 bp, Rattus norvegicus
  CDS (192)..(2315)
gctgccacggagtcctcccctgctgtggagcaatggtaaagcccgcagctcaaattccgagaattgagctctgttgattcttagaactggggttcttagaagtggtgatgcaagaagtttctaggaaaggccggacaccagttttaaagcaaaattttggactgtgaagcaaggcattgggcaaacacaacatggcctcaccggctgacagctgtatccagttcacccgccatgctagtgatgttcttctcaaccttaaccgcctccgaagtcgggacatcttgaccgacgttgtcatcgtggtgagccgtgagcagtttagagcccataagacagtgctcatggcctgcagtggcctgttctacagcatcttcactgaccagttgaaatgcaaccttagtgtaatcaatctggatcctgagatcagccctgaggggttttgcatcctcttggacttcatgtacacatctaggctcaacctgagggaaggcaacatcatggccgtgatggccacagccatgtacctgcagatggagcatgttgtcgacacatgccggaagttcatcaaggccagtgaagcagaaatggcccctgcacttaagcctccccgtgaagagttcctgaacagccggatgctgatgccccatgacgtcatggcctatcgaggtcgtgaggttgtggagaacaatatgccactaagaaatactcccgggtgtgagagtagagcttttgcccctcccctgtacagtggcctgtcgacaccaccagcctcttatccgatgtatagccatctcccgctcagcagtttcctcttctccgacgaggaactacgagatgccccccgaatgcctgtggctaacccttttcccaaggagcgcgccctcccctgtgacagtgccaggccagtccctaatgagtatagcaggccaaccatggaggtgtcccccagcttgtgccacagcaatatctactcgcccaaggaggcagtcccagaggaggctcggagtgacatacactacagtgtgactgagggccccaagcctgctgccccttctgctcggcatgcctcgtacttcccctgtgacaaagccagcaaagaagaagagagaccctcttcagaggacgagatcgccctgcatttcgagccccccaatgcacccttgaaccggaagggtctggttagtccccagagtccgcagaaatccgactgccagcccaactcacccacagagtcctccagcagcaagaacgcctgcatccttcaggcctctggctctcctccagccaagagccccactgatccgaaagcctgcaactggaagaagtataagttcatcgttctcaacagcctcaatcagaatgccaagccagagggctctgagcaggcagagctgggccgcctctccccacgagcctaccctgcaccgccggcctgccagccgcctatggagcctgcgaaccttgatctccagtctccaaccaagctcagtgccagtggggaggactctaccatcccccaagccagccggctcaataacatcgttaacaggtccctggcaggctccccccgaagcagcagcgagagccactcgccactctacatgcaccccccgaagtgcacatcctgcggctctcagtccccacagcatacagagatgtgtctccatactgccgggcccacattcccggaggagatgggagagacccagtcagagtattcggattctagctgtgagaatggggccttcttctgcaatgaatgtgactgccgtttttctgaggaggcctcactcaagaggcacacgctgcagacgcacagtgacaaaccatacaaatgtgaccgctgccaggcctccttccgctacaaaggcaacctcgccagccacaagacggtccacacaggtgaaaaaccctaccgctgtaacatttgtggagcgcagttcaatcggccagccaacctgaagacccacactcgaattcactctggagaaaagccctacaaatgtgaaacctgtggggccagatttgtgcaggtggctcacctccgtgcccacgtgctcatccacactggagagaagccgtacccctgtgaaatctgtggtacccgcttcaggcaccttcagactctaaagagccatctgcgcatccacacaggagagaaaccgtaccattgtgagaagtgtaacctgcactttcgtcacaaaagccaactgcgacttcatttgcgtcagaaacatggcgccatcaccaacaccaaggtgcaataccgtgtgtcggccgctgatttgcctccggagctccccaaagcctgctgaagcatggagtgttgactctttttctctccagccccttctcagaatctacccaaaggatgctgtaacactttacaaaggtcatcccatgacgtagtgcctctctcatccactagagcaaatcatagttggggtgggggtgggggtgggggtggggtttgcgggaccgggagccaaggcagctctccttcccacactgccataaaacattaagaaaatactatcgcttcttctcctatgtgtaaggcaaaccacgtcagcaaaaatgcaaaatcattttcaatatcaaaataggggagaacgcagaagttctgacttgacaggttgcaacatgaggaatgtaaatgttctgtggggacagagatctcttttgtatgtaaatgtgcattgttttaaaagacaagacttcagtatgttgtcaaagagagggctttaattttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattatgtctgtataagtaagaaaatattttgtctaaaatgcctccgtgtatttgtatttttttgcaagtgaaggtttacaatttacaaagtgtgtattaaaaacaaaaaagaacaaaaaaaagctgcagaaggagaaatgtatacttttgttctggttttcactttgtacatacctgtaaacgtgtcctcacggtgcctttttacacggaagttttcaatgatggacgggtgtgggccatccctttttgaagtgtaggcagacacagggacttgaagttgtcactaactaaactctctttgggaatgtttgactcctcccacattctgcgtcatgcttgttataattactccggagacagggtttggctgtgtctaaactgcattagtgcgttgtaaaatatagctgtatctgtataaaatataagaataaaacatggaaaagtc

SEQ ID NO: 62 - protein, 707 aa, Rattus norvegicus
MASPADSCIQFTRHASDVLLNLNRLRSRDILTDVVIVVSREQFRAHKTVLMACSGLFYSIFTDQLKCNLSVINLDPEISPEGFCILLDFMYTSRLNLREGNIMAVMATAMYLQMEHVVDTCRKFIKASEAEMAPALKPPREEFLNSRMLMPHDVMAYRGREVVENNMPLRNTPGCESRAFAPPLYSGLSTPPASYPMYSHLPLSSFLFSDEELRDAPRMPVANPFPKERALPCDSARPVPNEYSRPTMEVSPSLCHSNIYSPKEAVPEEARSDIHYSVTEGPKPAAPSARHASYFPCDKASKEEERPSSEDEIALHFEPPNAPLNRKGLVSPQSPQKSDCQPNSPTESSSSKNACILQASGSPPAKSPTDPKACNWKKYKFIVLNSLNQNAKPEGSEQAELGRLSPRAYPAPPACQPPMEPANLDLQSPTKLSASGEDSTIPQASRLNNIVNRSLAGSPRSSSESHSPLYMHPPKCTSCGSQSPQHTEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSAADLPPELPKAC

SEQ ID NO: 63 - DNA, 4264 bp, Rattus norvegicus
  CDS (1065)..(3188)
atcgtagggcgccgagcggcgcggccccgaggcattctacgggccgggagggcgccacggcgcgcggcgctgccacggagtcctcccctgctgtggagcaatggtaaagcccgcagctcaaattccgagaattgagctctgttgattcttagaactggggttcttagaagtggtgatgcaagaagtttctaggaaaggccggacaccagttttaaagcaaaattttggactgtgaagcaaggcattgggtgagtaaatcaaattatatgctctaaaatttgtaggtgaatttttcctcttgaatttttcccatgctgcggtgtgtgtgtgtgtgtgtgtgtgtgtgtgtgtgtgtgtgtgtgtgtgaagtttgccacttgatgaacaaaaggataatgaattctctccacacagagctcaggtctcacccctctgacccttcagtaactgacttcataccattgtatatgtgggattcttccttcccgttctcagttcaggttaacctggctgcctacactgctagcattatgcgagtgctaagcactcaaactattgaacgaaacaacccccagtctcagcgcatgggatgaacagtgaaatgacataccgattaaaaatagctgcactcattttttttttaaagaacctattatggtgtaggcacatatttctaattttaaaaaccacataggtattgccgttcctattttggaaagtgaaagcccagaaacagtaacagcgcactccaagtaacagagctggtgaaaggcaaagcaagctgggtgactctccaagagtggttttctccattgcaacacactctcaatgcttggcagggtgtttagtatgcggaaaagcacttcacgggcagcccttcccttcccctttcccctaaagagctttctacaccagccttcattctccctatttgacagctacgaaaaggaatgcccagaaaatgggctaggacttgtccactgtatacctgagtcgctacagcaggctcacctaggttcgcaaggagtaataggagttttaacttctgcccaggcaaacacaacatggcctcaccggctgacagctgtatccagttcacccgccatgctagtgatgttcttctcaaccttaaccgcctccgaagtcgggacatcttgaccgacgttgtcatcgtggtgagccgtgagcagtttagagcccataagacagtgctcatggcctgcagtggcctgttctacagcatcttcactgaccagttgaaatgcaaccttagtgtaatcaatctggatcctgagatcagccctgaggggttttgcatcctcttggacttcatgtacacatctaggctcaacctgagggaaggcaacatcatggccgtgatggccacagccatgtacctgcagatggagcatgttgtcgacacatgccggaagttcatcaaggccagtgaagcagaaatggcccctgcacttaagcctccccgtgaagagttcctgaacagccggatgctgatgccccatgacgtcatggcctatcgaggtcgtgaggttgtggagaacaatatgccactaagaaatactcccgggtgtgagagtagagcttttgcccctcccctgtacagtggcctgtcgacaccaccagcctcttatccgatgtatagccatctcccgctcagcagtttcctcttctccgacgaggaactacgagatgccccccgaatgcctgtggctaacccttttcccaaggagcgcgccctcccctgtgacagtgccaggccagtccctaatgagtatagcaggccaaccatggaggtgtcccccagcttgtgccacagcaatatctactcgcccaaggaggcagtcccagaggaggctcggagtgacatacactacagtgtgactgagggccccaagcctgctgccccttctgctcggcatgcctcgtacttcccctgtgacaaagccagcaaagaagaagagagaccctcttcagaggacgagatcgccctgcatttcgagccccccaatgcacccttgaaccggaagggtctggttagtccccagagtccgcagaaatccgactgccagcccaactcacccacagagtcctccagcagcaagaacgcctgcatccttcaggcctctggctctcctccagccaagagccccactgatccgaaagcctgcaactggaagaagtataagttcatcgttctcaacagcctcaatcagaatgccaagccagagggctctgagcaggcagagctgggccgcctctccccacgagcctaccctgcaccgccggcctgccagccgcctatggagcctgcgaaccttgatctccagtctccaaccaagctcagtgccagtggggaggactctaccatcccccaagccagccggctcaataacatcgttaacaggtccctggcaggctccccccgaagcagcagcgagagccactcgccactctacatgcaccccccgaagtgcacatcctgcggctctcagtccccacagcatacagagatgtgtctccatactgccgggcccacattcccggaggagatgggagagacccagtcagagtattcggattctagctgtgagaatggggccttcttctgcaatgaatgtgactgccgtttttctgaggaggcctcactcaagaggcacacgctgcagacgcacagtgacaaaccatacaaatgtgaccgctgccaggcctccttccgctacaaaggcaacctcgccagccacaagacggtccacacaggtgaaaaaccctaccgctgtaacatttgtggagcgcagttcaatcggccagccaacctgaagacccacactcgaattcactctggagaaaagccctacaaatgtgaaacctgtggggccagatttgtgcaggtggctcacctccgtgcccacgtgctcatccacactggagagaagccgtacccctgtgaaatctgtggtacccgcttcaggcaccttcagactctaaagagccatctgcgcatccacacaggagagaaaccgtaccattgtgagaagtgtaacctgcactttcgtcacaaaagccaactgcgacttcatttgcgtcagaaacatggcgccatcaccaacaccaaggtgcaataccgtgtgtcggccgctgatttgcctccggagctccccaaagcctgctgaagcatggagtgttgactctttttctctccagccccttctcagaatctacccaaaggatgctgtaacactttacaaaggtcatcccatgacgtagtgcctctctcatccactagagcaaatcatagttggggtgggggtgggggtgggggtggggtttgcgggaccgggagccaaggcagctctccttcccacactgccataaaacattaagaaaatactatcgcttcttctcctatgtgtaaggcaaaccacgtcagcaaaaatgcaaaatcattttcaatatcaaaataggggagaacgcagaagttctgacttgacaggttgcaacatgaggaatgtaaatgttctgtggggacagagatctcttttgtatgtaaatgtgcattgttttaaaagacaagacttcagtatgttgtcaaagagagggctttaattttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattatgtctgtataagtaagaaaatattttgtctaaaatgcctccgtgtatttgtatttttttgcaagtgaaggtttacaatttacaaagtgtgtattaaaaacaaaaaagaacaaaaaaaagctgcagaaggagaaatgtatacttttgttctggttttcactttgtacatacctgtaaacgtgtcctcacggtgcctttttacacggaagttttcaatgatggacgggtgtgggccatccctttttgaagtgtaggcagacacagggacttgaagttgtcactaactaaactctctttgggaatgtttgactcctcccacattctgcgtcatgcttgttataattactccggagacagggtttggctgtgtctaaactgcattagtgcgttgtaaaatatagctgtatctgtataaaatataagaataaaacatggaaaagtcga

SEQ ID NO: 64 - protein, 707 aa, Rattus norvegicus; identical to SEQ ID NO: 62

SEQ ID NO: 65 - DNA, 3315 bp, Rattus norvegicus
  CDS (92)..(2215)
agtggtgatgcaagaagtttctaggaaaggccggacaccagttttaaagcaaaattttggactgtgaagcaaggcattgggcaaacacaacatggcctcaccggctgacagctgtatccagttcacccgccatgctagtgatgttcttctcaaccttaaccgcctccgaagtcgggacatcttgaccgacgttgtcatcgtggtgagccgtgagcagtttagagcccataagacagtgctcatggcctgcagtggcctgttctacagcatcttcactgaccagttgaaatgcaaccttagtgtaatcaatctggatcctgagatcagccctgaggggttttgcatcctcttggacttcatgtacacatctaggctcaacctgagggaaggcaacatcatggccgtgatggccacagccatgtacctgcagatggagcatgttgtcgacacatgccggaagttcatcaaggccagtgaagcagaaatggcccctgcacttaagcctccccgtgaagagttcctgaacagccggatgctgatgccccatgacgtcatggcctatcgaggtcgtgaggttgtggagaacaatatgccactaagaaatactcccgggtgtgagagtagagcttttgcccctcccctgtacagtggcctgtcgacaccaccagcctcttatccgatgtatagccatctcccgctcagcagtttcctcttctccgacgaggaactacgagatgccccccgaatgcctgtggctaacccttttcccaaggagcgcgccctcccctgtgacagtgccaggccagtccctaatgagtatagcaggccaaccatggaggtgtcccccagcttgtgccacagcaatatctactcgcccaaggaggcagtcccagaggaggctcggagtgacatacactacagtgtgactgagggccccaagcctgctgccccttctgctcggcatgcctcgtacttcccctgtgacaaagccagcaaagaagaagagagaccctcttcagaggacgagatcgccctgcatttcgagccccccaatgcacccttgaaccggaagggtctggttagtccccagagtccgcagaaatccgactgccagcccaactcacccacagagtcctccagcagcaagaacgcctgcatccttcaggcctctggctctcctccagccaagagccccactgatccgaaagcctgcaactggaagaagtataagttcatcgttctcaacagcctcaatcagaatgccaagccagagggctctgagcaggcagagctgggccgcctctccccacgagcctaccctgcaccgccggcctgccagccgcctatggagcctgcgaaccttgatctccagtctccaaccaagctcagtgccagtggggaggactctaccatcccccaagccagccggctcaataacatcgttaacaggtccctggcaggctccccccgaagcagcagcgagagccactcgccactctacatgcaccccccgaagtgcacatcctgcggctctcagtccccacagcatacagagatgtgtctccatactgccgggcccacattcccggaggagatgggagagacccagtcagagtattcggattctagctgtgagaatggggccttcttctgcaatgaatgtgactgccgtttttctgaggaggcctcactcaagaggcacacgctgcagacgcacagtgacaaaccatacaaatgtgaccgctgccaggcctccttccgctacaaaggcaacctcgccagccacaagacggtccacacaggtgaaaaaccctaccgctgtaacatttgtggagcgcagttcaatcggccagccaacctgaagacccacactcgaattcactctggagaaaagccctacaaatgtgaaacctgtggggccagatttgtgcaggtggctcacctccgtgcccacgtgctcatccacactggagagaagccgtacccctgtgaaatctgtggtacccgcttcaggcaccttcagactctaaagagccatctgcgcatccacacaggagagaaaccgtaccattgtgagaagtgtaacctgcactttcgtcacaaaagccaactgcgacttcatttgcgtcagaaacatggcgccatcaccaacaccaaggtgcaataccgtgtgtcggccgctgatttgcctccggagctccccaaagcctgctgaagcatggagtgttgactctttttctctccagccccttctcagaatctacccaaaggatgctgtaacactttacaaaggtcatcccatgacgtagtgcctctctcatccactagagcaaatcatagttggggtgggggtgggggtgggggtggggtttgcgggaccgggagccaaggcagctctccttcccacactgccataaaacattaagaaaatactatcgcttcttctcctatgtgtaaggcaaaccacgtcagcaaaaatgcaaaatcattttcaatatcaaaataggggagaacgcagaagttctgacttgacaggttgcaacatgaggaatgtaaatgttctgtggggacagagatctcttttgtatgtaaatgtgcattgttttaaaagacaagacttcagtatgttgtcaaagagagggctttaattttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattatgtctgtataagtaagaaaatattttgtctaaaatgcctccgtgtatttgtatttttttgcaagtgaaggtttacaatttacaaagtgtgtattaaaaacaaaaaagaacaaaaaaaagctgcagaaggagaaatgtatacttttgttctggttttcactttgtacatacctgtaaacgtgtcctcacggtgcctttttacacggaagttttcaatgatggacgggtgtgggccatccctttttgaagtgtaggcagacacagggacttgaagttgtcactaactaaactctctttgggaatgtttgactcctcccacattctgcgtcatgcttgttataattactccggagacagggtttggctgtgtctaaactgcattagtgcgttgtaaaatatagctgtatctgtataaaatataagaataaaacatggaaaagtcgaaaaaaaaaaaaaaaaaaaaaaaaa

SEQ ID NO: 66 - protein, 707 aa, Rattus norvegicus; identical to SEQ ID NO: 62

SEQ ID NO: 67 - DNA, 3326 bp, Mus musculus
  CDS (89)..(2212)
ggtgatgcaagaagtttctaggaaaggccggacaccagttttaaagcaaaattttggactgtgaagcaaggcactgggcaaacacaacatggcctccccggctgacagctgtatccagtttacccggcacgctagtgatgttcttctcaaccttaatcgcctccggagtcgggacatcttgacggacgttgtcatcgtggtgagccgtgagcagtttagagcccataagacagtgctcatggcctgcagcggcctgttctacagtatcttcactgaccagttgaaatgcaaccttagtgtaatcaatctagatcctgaaatcagccctgaggggttttgcatcctcctggacttcatgtacacatctaggctcaacctgagggaaggcaatatcatggcggtgatgaccacagccatgtacctgcagatggagcatgttgtcgacacatgcaggaagttcatcaaggccagtgaagcagaaatggcccctgcacttaaacctccccgtgaagagttcctgaacagccggatgctgatgccccatgacatcatggcctaccgaggtcgtgaggtcgtggagaacaatatgccactgagaaatactcccgggtgtgagagcagagcttttgctcctcctctgtacagtggcctgtcaacaccaccagcctcttatcccatgtacagccatctcccgctcagcaccttcctcttctctgatgaggagctccgagatgccccccgaatgcctgtggccaacccttttcccaaggagcgtgccctcccctgcgacagtgccaggcaagtccctaatgagtatagcaggccagccatggaggtgtcccccagtttgtgtcacagcaacatctactcgcccaaggaggcagtcccagaggaggctcggagtgacatacactacagtgtgcctgagggccccaagcctgctgtcccttctgctcggaatgctccatacttcccctgtgacaaagccagcaaagaagaagagagaccttcttcggaggatgagattgccctgcatttcgagccccccaatgcacccttgaaccggaagggtctggttagtccccagagtccccagaaatccgactgccagcccaactcacccacagagtcctgcagcagcaagaacgcctgcatccttcaggcctctggctctccgccagccaagagccccactgacccgaaagcctgcaactggaagaagtataagttcatcgttctcaacagcctcaatcagaatgccaaacccgagggctctgagcaggcagagctgggtcgcctctcccctcgagcctaccctgcaccgcccgcttgccagccgcctatggagcccgcgaaccttgatctccagtccccgaccaagctcagtgccagtggggaggactctaccatcccccaagccagccggctcaataatctcgtgaacaggtccctggcaggctccccccgaagcagcagtgagagtcactcaccactctacatgcaccccccaaagtgcacatcctgcggctctcagtccccacagcatacagagatgtgcctccatactgctgggcccacgttcccggaggagatgggggaaacccagtcagagtattcggattctagctgtgagaatgggaccttcttctgcaacgaatgtgactgccgtttctctgaggaggcctcgctcaagaggcacacgctgcagacgcacagtgacaaaccatacaaatgtgatcgctgccaggcctccttccgctacaagggcaacctcgccagccacaagactgtccacacgggtgagaaaccctatcgctgtaacatttgtggagcgcagttcaatcggccagccaacctgaagacccacactcgaattcactctggagaaaagccctacaaatgtgaaacctgtggggccaggtttgttcaggtggcccacctccgtgcccacgtgctcatccacactggagagaagccgtacccctgtgaaatctgtggcactcgcttccggcaccttcagactctgaagagccatctgcgcatccacacaggagagaaaccttaccattgtgagaagtgtaacctgcactttcgtcacaaaagccaactgcgacttcatttgcgccagaagcacggcgccatcaccaacaccaaggtgcaataccgcgtgtcggccgctgacctgcctccggagctccccaaagcctgctgaatgaagcatggagtgttcctcgccctttcctctccagccccttctcagaatctacccaaaggatgctgtaacactttatacaaaggtcatcccatgatgtagtgcctctctcatccactagtgcaaatcatagttggggtgggggtgggggtggggtttgcgggaccgggagccaaggcagctccccttcccacactgccataaaacattaagaaaatactattgcttcttctcctatgtgtaaggcaaaccctgtcagcaaaaagcaaattcattttctatatcaaagtaggggagaatgcagaagttctgacttgacaggttgcaaccgaggaatgtaaatgatgtgtgggaacagaggtctcttttgtatgtaaatgtgtattgttttaaaagacaagacttcagtatgctgtcaaagagaaggctttaatttttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattgcgtctgtataagtaagaaaatattttgtctaaaatgcctccgtgtatttgtatttttttgcaagtgaaggtttacaaatttacaaagtgtgtattaaaaacaaaaagaacaaaaaaaaaagctgcagaaggagaaatgtatacttttgttccagttttcagtttgtacatacctgtaatgtgtcctcacggtgcctttttacacggaagttttcaatgatggacgggtgtgcgccatccctttttgaagtgtaggcagacacagggacttgaagttgtcactaactaaactctctttgggaatgtttgactcctcccacattctgcgtcatgcttgtcgttataattactccggagacagggtttggctgtgtctaaactgcattagtgcgttgtaaaatagagctgtacaaaacataagaataaaacattgaaaagtcttgaaaaaaaaaaaaaaaaaaaaaaaaaaaaaaaaaaaaaa

SEQ ID NO: 68 - protein, 707 aa, Mus musculus
MASPADSCIQFTRHASDVLLNLNRLRSRDILTDVVIVVSREQFRAHKTVLMACSGLFYSIFTDQLKCNLSVINLDPEISPEGFCILLDFMYTSRLNLREGNIMAVMTTAMYLQMEHVVDTCRKFIKASEAEMAPALKPPREEFLNSRMLMPHDIMAYRGREVVENNMPLRNTPGCESRAFAPPLYSGLSTPPASYPMYSHLPLSTFLFSDEELRDAPRMPVANPFPKERALPCDSARQVPNEYSRPAMEVSPSLCHSNIYSPKEAVPEEARSDIHYSVPEGPKPAVPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGSEQAELGRLSPRAYPAPPACQPPMEPANLDLQSPTKLSASGEDSTIPQASRLNNLVNRSLAGSPRSSSESHSPLYMHPPKCTSCGSQSPQHTEMCLHTAGPTFPEEMGETQSEYSDSSCENGTFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSAADLPPELPKAC

SEQ ID NO: 69 - DNA, 3307 bp, Mus musculus
  CDS (111)..(2234)
gagaactggggttcttagaagtggtgatgcaagaagtttctaggaaaggccggacaccagttttaaagcaaaattttggactgtgaagcaaggcactgggcaaacacaacatggcctccccggctgacagctgtatccagtttacccggcacgctagtgatgttcttctcaaccttaatcgcctccggagtcgggacatcttgacggacgttgtcatcgtggtgagccgtgagcagtttagagcccataagacagtgctcatggcctgcagcggcctgttctacagtatcttcactgaccagttgaaatgcaaccttagtgtaatcaatctagatcctgaaatcagccctgaggggttttgcatcctcctggacttcatgtacacatctaggctcaacctgagggaaggcaatatcatggcggtgatgaccacagccatgtacctgcagatggagcatgttgtcgacacatgcaggaagttcatcaaggccagtgaagcagaaatggcccctgcacttaaacctccccgtgaagagttcctgaacagccggatgctgatgccccatgacatcatggcctaccgaggtcgtgaggtcgtggagaacaatatgccactgagaaatactcccgggtgtgagagcagagcttttgctcctcctctgtacagtggcctgtcaacaccaccagcctcttatcccatgtacagccatctcccgctcagcaccttcctcttctctgatgaggagctccgagatgccccccgaatgcctgtggccaacccttttcccaaggagcgtgccctcccctgcgacagtgccaggcaagtccctaatgagtatagcaggccagccatggaggtgtcccccagtttgtgtcacagcaacatctactcgcccaaggaggcagtcccagaggaggctcggagtgacatacactacagtgtgcctgagggccccaagcctgctgtcccttctgctcggaatgctccatacttcccctgtgacaaagccagcaaagaagaagagagaccttcttcggaggatgagattgccctgcatttcgagccccccaatgcacccttgaaccggaagggtctggttagtccccagagtccccagaaatccgactgccagcccaactcacccacagagtcctgcagcagcaagaacgcctgcatccttcaggcctctggctctccgccagccaagagccccactgacccgaaagcctgcaactggaagaagtataagttcatcgttctcaacagcctcaatcagaatgccaaacccgagggctctgagcaggcagagctgggtcgcctctcccctcgagcctaccctgcaccgcccgcttgccagccgcctatggagcccgcgaaccttgatctccagtccccgaccaagctcagtgccagtggggaggactctaccatcccccaagccagccggctcaataatctcgtgaacaggtccctggcaggctccccccgaagcagcagtgagagtcactcaccactctacatgcaccccccaaagtgcacatcctgcggctctcagtccccacagcatacagagatgtgcctccatactgctgggcccacgttcccggaggagatgggggaaacccagtcagagtattcggattctagctgtgagaatgggaccttcttctgcaacgaatgtgactgccgtttctctgaggaggcctcgctcaagaggcacacgctgcagacgcacagtgacaaaccatacaaatgtgatcgctgccaggcctccttccgctacaagggcaacctcgccagccacaagactgtccacacgggtgagaaaccctatcgctgtaacatttgtggagcgcagttcaatcggccagccaacctgaagacccacactcgaattcactctggagaaaagccctacaaatgtgaaacctgtggggccaggtttgttcaggtggcccacctccgtgcccacgtgctcatccacactggagagaagccgtacccctgtgaaatctgtggcactcgcttccggcaccttcagactctgaagagccatctgcgcatccacacaggagagaaaccttaccattgtgagaagtgtaacctgcactttcgtcacaaaagccaactgcgacttcatttgcgccagaagcacggcgccatcaccaacaccaaggtgcaataccgcgtgtcggccgctgacctgcctccggagctccccaaagcctgctgaatgaagcatggagtgttcctcgccctttcctctccagccccttctcagaatctacccaaaggatgctgtaacactttatacaaaggtcatcccatgatgtagtgcctctctcatccactagtgcaaatcatagttggggtgggggtgggggtggggtttgcgggaccgggagccaaggcagctccccttcccacactgccataaaacattaagaaaatactattgcttcttctcctatgtgtaaggcaaaccctgtcagcaaaaagcaaattcattttctatatcaaagtaggggagaatgcagaagttctgacttgacaggttgcaaccgaggaatgtaaatgatgtgtgggaacagaggtctcttttgtatgtaaatgtgtattgttttaaaagacaagacttcagtatgctgtcaaagagaaggctttaatttttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattgcgtctgtataagtaagaaaatattttgtctaaaatgcctccgtgtatttgtatttttttgcaagtgaaggtttacaaatttacaaagtgtgtattaaaaacaaaaagaacaaaaaaaaaagctgcagaaggagaaatgtatacttttgttccagttttcagtttgtacatacctgtaatgtgtcctcacggtgcctttttacacggaagttttcaatgatggacgggtgtgcgccatccctttttgaagtgtaggcagacacagggacttgaagttgtcactaactaaactctctttgggaatgtttgactcctcccacattctgcgtcatgcttgtcgttataattactccggagacagggtttggctgtgtctaaactgcattagtgcgttgtaaaatagagctgtacaaaacataagaataaaacattgaaaagtc

SEQ ID NO: 70 - protein, 707 aa, Mus musculus; identical to SEQ ID NO: 68

SEQ ID NO: 71 - DNA, 3289 bp, Mus musculus
  CDS (113)..(2236)
gttagaactggggttcttagaagtggtgatgcaagaagtttctaggaaaggccggacaccagttttaaagcaaaattttggactgtgaagcaaggcactgggcaaacacaacatggcctccccggctgacagctgtatccagtttacccggcacgctagtgatgttcttctcaaccttaatcgcctccggagtcgggacatcttgacggacgttgtcatcgtggtgagccgtgagcagtttagagcccataagacagtgctcatggcctgcagcggcctgttctacagtatcttcactgaccagttgaaatgcaaccttagtgtaatcaatctagatcctgaaatcagccctgaggggttttgcatcctcctggacttcatgtacacatctaggctcaacctgagggaaggcaatatcatggcggtgatgaccacagccatgtacctgcagatggagcatgttgtcgacacatgcaggaagttcatcaaggccagtgaagcagaaatggcccctgcacttaaacctccccgtgaagagttcctgaacagccggatgctgatgccccatgacatcatggcctaccgaggtcgtgaggtcgtggagaacaatatgccactgagaaatactcccgggtgtgagagcagagcttttgctcctcctctgtacattggcctgtcaacaccaccagcctcttatcccatgtacagccatctcccgctcagcaccttcctcttctctgatgaggagctccgagatgccccccgaatgcctgtggccaacccttttcccaaggagcgtgccctcccctgcgacagtgccaggcaagtccctaatgagtatagcaggccagccatggaggtgtcccccagtttgtgtcacagcaacatctactcgcccaaggaggcagtcccagaggaggctcggagtgacatacactacagtgtgcctgagggccccaagcctgctgtcccttctgctcggaatgctccatacttcccctgtgacaaagccagcaaagaagaagagagaccttcttcggaggatgagattgccctgcatttcgagccccccaatgcacccttgaaccggaagggtctggttagtccccagagtccccagaaatccgactgccagcccaactcacccacagagtcctgcagcagcaagaacgcctgcatccttcaggcctctggctctccgccagccaagagccccactgacccgaaagcctgcaactggaagaagtataagttcatcgttctcaacagcctcaatcagaatgccaaacccgagggctctgagcaggcagagctgggtcgcctctcccctcgagcctaccctgcaccgcccgcttgccagccgcctatggagcccgcgaaccttgatctccagtccccgaccaagctcagtgccagtggggaggactctaccatcccccaagccagccggctcaataatctcgtgaacaggtccctggcaggctccccccgaagcagcagtgagagtcactcaccactctacatgcaccccccaaagtgcacatcctgcggctctcagtccccacagcatacagagatgtgcctccatactgctgggcccacgttcccggaggagatgggggaaacccagtcagagtattcggattctagctgtgagaatgggaccttcttctgcaacgaatgtgactgccgtttctctgaggaggcctcgctcaagaggcacacgctgcagacgcacagtgacaaaccatacaaatgtgatcgctgccaggcctccttccgctacaagggcaacctcgccagccacaagactgtccacacgggtgagaaaccctatcgctgtaacatttgtggagcgcagttcaatcggccagccaacctgaagacccacactcgaattcactctggagaaaagccctacaaatgtgaaacctgtggggccaggtttgttcaggtggcccacctccgtgcccacgtgctcatccacactggagagaagccgtacccctgtgaaatctgtggcactcgcttccggcaccttcagactctgaagagccatctgcgcatccacacaggagagaaaccttaccattgtgagaagtgtaacctgcactttcgtcacaaaagccaactgcgacttcatttgcgccagaagcacggcgccatcaccaacaccaaggtgcaataccgcgtgtcggccgctgacctgcctccggagctccccaaagcctgctgaatgaagcatggagtgttcctcgccctttcctctccagccccttctcagaatctacccaaaggatgctgtaacactttatacaaaggtcatcccatgatgtagtgcctctctcatccactagtgcaaatcatagttggggtgggggtgggggtggggtttgcgggaccgggagccaaggcagctccccttcccacactgccataaaacattaagaaaatactattgcttcttctcctatgtgtaaggccaaaccctgtcagcaaaaagcaaattcattttctatatcaaagtaggggagaatgcacaagttctgacttgaccaggttgcaaccgaggaatgtaaatgatgtgtgggaacagaggtctcttttgtatgtaaatgtgtattgttttaaaagacaagacttcagtatgctgtcaaagagaaggctttaatttttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattgcgtctgtataagtaagaaaatattttgtctaaaatgcctccgtgtatttgtatttttttgcaagtgaaggtttacaaatttacaaagtgtgtattaaaaacaaaaagaacaaaaaaaaaagctgcagaaggagaaatgtatacttttgttccagttttcagtttgtacatacctgtaatgtgtcctcacggtgcctttttacacggaagttttcaatgatggacgggtgtgcgccatccctttttgaagtgtaggcagacacagggacttgaagttgtcactaactaaactctctttgggaatgtttgactcctcccacattctgcgtcatgcttgtcgttataattactccggagacagggtttggctgtgtctaaactgcattagtgcgttgtaaaatagagctgtacaaaacat

SEQ ID NO: 72 - protein, 707 aa, Mus musculus
MASPADSCIQFTRHASDVLLNLNRLRSRDILTDVVIVVSREQFRAHKTVLMACSGLFYSIFTDQLKCNLSVINLDPEISPEGFCILLDFMYTSRLNLREGNIMAVMTTAMYLQMEHVVDTCRKFIKASEAEMAPALKPPREEFLNSRMLMPHDIMAYRGREVVENNMPLRNTPGCESRAFAPPLYIGLSTPPASYPMYSHLPLSTFLFSDEELRDAPRMPVANPFPKERALPCDSARQVPNEYSRPAMEVSPSLCHSNIYSPKEAVPEEARSDIHYSVPEGPKPAVPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGSEQAELGRLSPRAYPAPPACQPPMEPANLDLQSPTKLSASGEDSTIPQASRLNNLVNRSLAGSPRSSSESHSPLYMHPPKCTSCGSQSPQHTEMCLHTAGPTFPEEMGETQSEYSDSSCENGTFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSAADLPPELPKAC

SEQ ID NO: 73 - DNA, 4894 bp, Homo sapiens
  CDS (21)..(2387)
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgtgccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtgattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagacca

SEQ ID NO: 74 - protein, 788 aa, Homo sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 75 - DNA, 4428 bp, Homo sapiens
  CDS (19)..(2385)
ccgcgggaggcggacgagatgcgagcgcggccgcggccccggccgctctgggtgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccaggattgcaggagtccctgccatcatgtttacagaggacagtatttgtggggagggatttcggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcaaagatttgccttattggcagctctactctggaggtttgtttagaagaagtgtgtcacccttaggccagcaccatctctttacctcctaattccacaccctcactgctgtagacatttgctatgacctggggatgtctctcatgaccaaatgcttttcctcaaagggagagagtgctattgtagagccagaggtctggccctatgcttccggcctcctgtccctcatccatagcacctccacatacctggccctgagccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttacaacctcatttaactcagtctttaatctgagaggccacagtgcaattttattttatttttctcatgatgaggttttcttaacttaaaagaacatgtatataaacatgcttgcattatatttgtaaatttatgtgtatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgtttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaa

SEQ ID NO: 76 - protein, 788 aa, Homo sapiens [sequence omitted]

SEQ ID NO: 77 - DNA, 5918 bp, Gorilla gorilla gorilla
  CDS (22)..(2388)
gcgccgcgggaggcggacgagatgcgagcgcggccgcggccccggccgttctgggcgactgtgctggcgctgggggcgctggcgggtgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcaaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcccaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaagagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaagctcctcatcaccatccatgaccgaaaagagttcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggtttcttcctgcttagcttgagggtgactatggagttgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccgtcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatcaatagcacctccatatacccggccctgtgccttggtgtgctgtatccatccatggggctgattgtatttaccttctacctcttggctgccttgtgaaggaattattcccatgagttggctgggaataagtgccaggatggaatgatgggtcagttgtatcagcatgtgtggcctgttcttctatgggttggacaacctcattttaactcagtctttaatctgagaggccacagtgcaattttattttatttttctcatgatgaggttttcttaacttaaaagaacatgtatataaacatgcttacattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatacatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaggctgttttctagtttgagaaatgatgggattttagcagccagtcttgaaggtctctttcagtatcaacattctaagatgctgggacttactgtggcatcaaatgtgtggttaagattctctgggatattgatactgtttgtgtttttagttgggagatctgagagacctggctttggcaagagcagatgtcattccatatcacctttctcaatgaaagtctcattctatcctctctccaaacccttttccaacatttgttaatagttacatctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagtcctgtctcacccatggattactccttactgtagggaatggcaatatggtagagggataaataggggacggggagggacagtcatggatccaagaagtccttagaaatagtggcagggaacaggtgtggcagctcatgcctgtaattataaccttcagctactaagacaggtgtggtggctcacacctgtgattataatcttcagttactaagagtccattagagtgttaatgggacattttctttagataagatgttttatatgaagaaactgtattaaagggggaagaaaatgtatttaacaggtgaatcaaatcaggaatcttgtctgagctactggaatgaagttcacaggtcttgaagaccaatattatttgtcaatatgtggggataacctgtagctgcattcatgaggtagcaaatagcagttttggcctgtggggtgaacagctaaacagtgttctggcatcagataccatggcacaaagggattgtgtctagctcttttggagaaaatttatgtccagtctcaggatctgtggacaataacggaaaactttgaatattcctgacaagttgccatattaggagtcagttctttacttctctgagattcccaggtcatccatgatttttttttaaatttgagacaaggcctcactcttgttgcccaagctggaatgcaatggcaagatctcggttcactgcaatctctgcctctcaggttcaagccattctcctgcctcagcctccccagtagctgggattacaggcacccgccaccacacccggctaatttttgtatttttagtagagacggggttttaccatgttggccaggctggtctcgaactcctgaccttaggcgatccaccttccttggcctcccaaagtgctgggattacaagtgtgagccactgtgcccggccagtcatccatgattttaatgtgggggtccaaaggcctctttttctttgttaagtattcctggttgaaatttcttttcttttttttttttgagacagagtcttgctctatcacccaggctggagtgcagtggcgcgatctctgctcactgcaagcttcgcctcccgggttcacaccattctcctgcctcagcctcccgagtagctgggattacaggcgcctgccaccatgcccggctaatttctttttgtatttttagtagagacggtttcacggtgttagccaggaacgtctcgacctcctgacctcgtgatcctcccgcctcggcctcccaaagtgctgggattacaggcgtgagccactgcccctggccgtggttgaaatttcttaagtgccttcctgacttcctaaccaccttctctgtttgggtttgtgcaacaataaattaaatgtactttccaaaaagaa

SEQ ID NO: 78 - protein, 788 aa, Gorilla gorilla gorilla
MRARPRPRPFWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALKNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 79 - DNA, 5129 bp, Chlorocebus sabaeus
  CDS (45)..(2411)
gcgcccactgtggggcgggcggagcgcggcgggaggcggacgagatgcgagcgcagccgcggccccggccgctctgggcaactgtgctggcgctgggggcgctggcgggcgttggcgtcggagggcccaacatctgtaccacgcgaggtgtgagctcctgccagcagtgtctggctgtgagccccatgtgtgcctggtgctctgatgaggccctgccgctgggctcacctcgctgtgacctgaaggagaatctgctgaaggataactgtgccccggaatccatcgagttcccagtcagtgaggcccgagtactagaggacaggcccctcagcgacaaaggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggacgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgtcgctaactgaccaggtgacccgcttcaatgaggaagtgaagaagcagagtgtgtcacggaaccgagatgctccagagggtggctttgatgccatcatgcaggctacagtctgtgatgaaaagattggctggaggaatgatgcatcacacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctctcccagaaaaacatcaatttgatctttgcagtgactgaaaatgtagtcaatctctatcagaactatagtgagctcatcccagggaccacagtcggggttctgtccatggattccagcaatgtcctccagctcattgttgatgcttatgggaaaatccgctctaaagtcgagctggaagtgcgtgacctccctgaagaattgtctctatccttcaacgccacctgcctcaacaatgaggtcatccctggcctcaagtcttgtatgggactcaagattggagacacggtgagcttcagcattgaggccaaggtgcgaggctgcccccaggagaaggagaagtcctttaccatcaagcccgtgggcttcaaggacagcctgatcgtccaggtcacctttgattgcgactgtgcctgccaggcccaagctgaacctaatagccgtcactgcaacaatggcaatgggacctttgagtgtggggtgtgccgttgtgggcctggctggctgggatcccagtgtgagtgctcagaggaagactatcgcccttcccagcaggacgagtgcagcccccgggagggtcagcccgtctgcagccagcggggcgagtgtctctgtggtcaatgtgtctgccacagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgcaccacacgtactgacacctgcatgtccagcaatgggctgctgtgcagcggccgtggcaagtgtaaatgtggcagctgtgtctgtatccagccgggctcctatggggacacctgtgagaagtgccctacctgcccagatgcctgcacctttaagaaagaatgcgtagagtgtaagaagtttgaccggggagccctacatgatgaaaatacctgcaaccgttactgccgcgatgagattgagtcagtgaaagagcttaaggacactggcaaggatgcagtgaattgtacctataagaatgaggatgactgtgtcgtcagattccagtactatgaagactctagtggaaagtccatcctgtatgtggtagaagagccagagtgtcccaagggccctgacatcctggtggtcctgctgtcagtgatgggggccattctgctcatcggccttgccactctgctcatctggaagctcctcatcaccatccacgaccgaaaagagtttgctaaatttgaggaagaacgcgccagagcaaaatgggacacagccaacaacccactgtataaagaggccacgtctaccttcaccaatatcacctaccggggcacttaatgataagcagtcatcctcagatcattatcagcctgtgccacgattgcaggagtctctgccatcatgtttacagaggacagtatttgtggggagggatttggggctcagagtggggtgggttgggagaatgtcagtatgtggaagtgtgggtctgtgtgtgtgtgtgtctgtgtgtgtgtgtgtgtgttgtgtgtgggagtgtgtaatttaaaattgtgatgtgtcctgataagccgagctccttagcctttgtccccagaatgcctcctgcaggggattcttcctgcttagcttgagggtgactatggagctgagcaggtgttcttcattacctcagtgagaagccagcttttctcatcaggccattgtccctgaagagaagggcaaggctgagacctctcattccagaggaggggacgccaaaccttggctctaccctgagttcataagtttatggttcttgggcctgactctcagcagctatagtaggaactgctgtgcttggcagcccaggtcatctgtacctctgcctcctttcccctccctcaggctgaaggaggagtcagggagagctgaactatcagagctgcctgtgccttttgccatcccctcaacccagctatggttctcttgcaagggaagtccttgcaacctaattctttgacctgttgggagtgaggatgtctgggtcactcagggtcattcatggcctgggggatgtaccagcatctcccagttcataatcacaacccttcagatttgccttattggcagctctactctggaggtttgtttagaagaagtgtgtcacccttagcccagcaccatctctttacctcctaattccacgccctcactgctgtagacatttgctatgagctggggatgtctctcatgaccaaatgcttttcctcaaagggagagagtgctattgtagagccagaggtctggccctacccttccggccttctgtccctcgttcatagcacctccacatacccagccctgtgccttggtgtgctgtatcgacccatggggctgattgtatttacctactacctcttggctgccttgtgaaggaattattcccatgagttggctgggaataagtgccaggatggaatgatgggtcggttgtaccagcatgtgtggcctgttctatgggttggacaacctcattttaactcagtctttaatctgagaggccacagtgcaattttattttatttttctcatgatgaggttttttaacctaaaggaatatgtatataaacatgcttgcgttatgtttgtaaatttatatgatggcaaagaaggagagcataggaagccacacagacttgggcagggtacagacactcccacttggcatcattcacagcaagtcactggccagtggctggatctgtgagtggctctctcatgatagaaggctatagggatagatgtatggacacattggacccttcctgaggaggagggactgttcttttgtctcagaaaagcagtggctccgttggtgttgacatacatccaacattaaaagccacccccaatcgcccaagagaaaaagaaacaaccttatcaacagttgttccatgagcagaaaacaggagttctgatctcagtgttgcagctaaataatctttaactctaattaaggcaagtcactttcttcttcttaaggctgttttctagtttgagaaatgggttttgagcagccagtcttgaaggtctctttcagtatcaacattctaagatgctgggacttactgtggcatcaaatgtgtggtcaagattctgtgggatattgatactgtgtgtgttttcagttgggagatctgagagacctggctttggcaagagcagatgtcattccatatcacctttctcaatgaaagtctcattctatcctctctccaaaccccttttccaacatttgttaatagttacatctctcctgatgtagcacttaagcttcatttagctattatttctttcttcactttgcacacatttgcatccacatattagggaaaaggaatccataagcagctgaaatatctattctgtattcttgtgttaacattgagaataagccttggaattagatatggggcaatggctgagccttgtctcacccatagattactccttactgtagggaatgggaatgtggtagaggcgtaaataggggacggggagggatagtcatggatccaagaagtctagaacctaattagcaccttcagttactaagacagagtccatgagaatcttaatgggacattttctttagataacatgttttatatgaataaattgtatcaaagcgggaaggaaatgtatttaaagggtgaatcaaatcaggaatcttgcctgagccactggaatgaagttcacaggtcttgaagaccagtactatttgtcagtatgtggggataacctgtagctgcattcatgaggtagcaaatagcagttttggcctgtggggtgaacagttaaacagtgttctggcatcagataacacagcacaaagggattgtgtctagctcttttggagaaaatttatgtctagtctcaggagctgtggacaataatgggaaactttgaatattcctgacaagttgccatattaggagtcagttctttacttctctgatattcctatgtcatccatgattttttttttttttttttttttttttttttaatttt

SEQ ID NO: 80 - protein, 788 aa, Chlorocebus sabaeus
MRAQPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLSLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSRHCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCKCGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 81 - DNA, 3769 bp, Chlorocebus sabaeus
  CDS (269)..(2494)
catcagccaggctgagagccttcccggccgccgcggcgctcacggtgccgtgggcttatctctgagtccggcgatcagcccgggctacgcgcgtcgttggtggtcccggtcgggccaaggactactggcccaggagccaaggcgaggtggggcttccggggattgttcccgggccttggcagagggatgccgccgtagcttcccggggcccaacatctgtaccacgcgaggtgtgagctcctgccagcagtgtctggctgtgagccccatgtgtgcctggtgctctgatgaggccctgccgctgggctcacctcgctgtgacctgaaggagaatctgctgaaggataactgtgccccggaatccatcgagttcccagtcagtgaggcccgagtactagaggacaggcccctcagcgacaaaggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggacgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgtcgctaactgaccaggtgacccgcttcaatgaggaagtgaagaagcagagtgtgtcacggaaccgagatgctccagagggtggctttgatgccatcatgcaggctacagtctgtgatgaaaagattggctggaggaatgatgcatcacacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctctcccagaaaaacatcaatttgatctttgcagtgactgaaaatgtagtcaatctctatcagaactatagtgagctcatcccagggaccacagtcggggttctgtccatggattccagcaatgtcctccagctcattgttgatgcttatgggaaaatccgctctaaagtcgagctggaagtgcgtgacctccctgaagaattgtctctatccttcaacgccacctgcctcaacaatgaggtcatccctggcctcaagtcttgtatgggactcaagattggagacacggtgagcttcagcattgaggccaaggtgcgaggctgcccccaggagaaggagaagtcctttaccatcaagcccgtgggcttcaaggacagcctgatcgtccaggtcacctttgattgcgactgtgcctgccaggcccaagctgaacctaatagccgtcactgcaacaatggcaatgggacctttgagtgtggggtgtgccgttgtgggcctggctggctgggatcccagtgtgagtgctcagaggaagactatcgcccttcccagcaggacgagtgcagcccccgggagggtcagcccgtctgcagccagcggggcgagtgtctctgtggtcaatgtgtctgccacagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgcaccacacgtactgacacctgcatgtccagcaatgggctgctgtgcagcggccgtggcaagtgtaaatgtggcagctgtgtctgtatccagccgggctcctatggggacacctgtgagaagtgccctacctgcccagatgcctgcacctttaagaaagaatgcgtagagtgtaagaagtttgaccggggagccctacatgatgaaaatacctgcaaccgttactgccgcgatgagattgagtcagtgaaagagcttaaggacactggcaaggatgcagtgaattgtacctataagaatgaggatgactgtgtcgtcagattccagtactatgaagactctagtggaaagtccatcctgtatgtggtagaagagccagagtgtcccaagggccctgacatcctggtggtcctgctgtcagtgatgggggccattctgctcatcggccttgccactctgctcatctggaagctcctcatcaccatccacgaccgaaaagagtttgctaaatttgaggaagaacgcgccagagcaaaatgggacacagccaacaacccactgtataaagaggccacgtctaccttcaccaatatcacctaccggggcacttaatgataagcagtcatcctcagatcattatcagcctgtgccacgattgcaggagtctctgccatcatgtttacagaggacagtatttgtggggagggatttggggctcagagtggggtgggttgggagaatgtcagtatgtggaagtgtgggtctgtgtgtgtgtgtgtctgtgtgtgtgtgtgtgtgttgtgtgtgggagtgtgtaatttaaaattgtgatgtgtcctgataagccgagctccttagcctttgtccccagaatgcctcctgcaggggattcttcctgcttagcttgagggtgactatggagctgagcaggtgttcttcattacctcagtgagaagccagcttttctcatcaggccattgtccctgaagagaagggcaaggctgagacctctcattccagaggaggggacgccaaaccttggctctaccctgagttcataagtttatggttcttgggcctgactctcagcagctatagtaggaactgctgtgcttggcagcccaggtcatctgtacctctgcctcctttcccctccctcaggctgaaggaggagtcagggagagctgaactatcagagctgcctgtgccttttgccatcccctcaacccagctatggttctcttgcaagggaagtccttgcaacctaattctttgacctgttgggagtgaggatgtctgggtcactcagggtcattcatggcctgggggatgtaccagcatctcccagttcataatcacaacccttcagatttgccttattggcagctctactctggaggtttgtttagaagaagtgtgtcacccttagcccagcaccatctctttacctcctaattccacgccctcactgctgtagacatttgctatgagctggggatgtctctcatgaccaaatgcttttcctcaaagggagagagtgctattgtagagccagaggtctggccctacccttccggccttctgtccctcgttcatagcacctccacatacccagccctgtgccttggtgtgctgtatcgacccatggggctgattgtatttacctactacctcttggctgccttgtgaaggaattattcccatgagttggctgggaataagtgccaggatggaatgatgggtcggttgtaccagcatgtgtggcctgttctatgggttggacaacctcattttaactcagtctttaatctgagaggccacagtgcaattttattttatttttctcatgatgaggttttttaacctaaaggaatatgtatataaaca

SEQ ID NO: 82 - protein, 741 aa, Chlorocebus sabaeus
MCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLSLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSRHCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCKCGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 83 - DNA, 4072 bp, Macaca mulatta
  CDS (22)..(2388)
gctcggcgggaggcggacgagatgcgagcgcagcccgggccccggccgctctgggcaactgtgctggcgctgggggcgctggcgggcgttggcgtcggagggcccaacatctgtaccacacgaggtgtgagctcctgccagcagtgcctggctgtgagccccatgtgtgcctggtgctctgatgaggccctgcctctgggctcacctcgctgtgacctgaaggagaatctgctgaaggataactgtgccccggaatccatcgagttcccagtcagtgaggcccgagtactagaggacaggcccctcagcgacaaaggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggacgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgtcgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcgcacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctctcccagaaaaacatcaatttgatctttgcagtgactgaaaatgtagtcaatctctatcagaactatagtgagctcatcccagggaccacagtcggggttctgtccatggattccagcaatgtcctccagctcattgttgatgcttatgggaaaatccgctctaaagtcgagctggaagtgcgtgacctccctgaagaattgtctctatccttcaacgccacctgcctcaacaatgaggtcatccctggcctcaagtcttgtatgggactcaagattggagacacggtgagcttcagcattgaggccaaggtgcgaggctgcccccaggagaaggagaagtcctttaccatcaagcccgtgggcttcaaggacagcctgatcgtccaggtcacctttgattgcgactgtgcctgccaggcccaagctgaacctaatagccgtcactgcaacaatggcaatgggacctttgagtgtggggtgtgccgttgtgggcctggctggctgggatcccagtgtgagtgctcagaggaggactatcgcccttcccagcaggacgagtgcagcccccgggagggtcagcccgtctgcagccagcggggcgagtgtctctgtggtcaatgtgtctgccacagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgcaccacacgtactgatacctgcatgtccagcaatgggctgctgtgcagcggccgcggcaagtgtgaatgtggcagctgtgtctgtatccagccgggctcctatggggacacctgtgagaagtgccctacctgcccagatgcctgcacctttaagaaagaatgcgtagagtgtaagaagtttgaccggggagccctacatgatgaaaatacctgcaaccgttactgccgcgatgagattgagtcagtgaaagagcttaaggacactggcaaggatgcagtgaattgtacctataagaatgaggatgactgtgtcgtcagattccagtactatgaagactctagtggaaagtccatcctgtatgtggtagaagagccagagtgtcccaagggccctgacatcctggtggtcctgctgtcagtgatgggggccattctgctcatcggccttgccactctgctcatctggaagctcctcatcaccatccacgaccgaaaagagtttgctaaatttgaggaagaacgcgccagagcaaaatgggacacagccaacaacccactgtataaagaggccacgtctaccttcaccaatatcacctaccggggcacttaatgataagcagtcatcctcagatcattatcagcctgtgccacgattgcaggagtctccgccatcatgtttacagaggacagtatttgtggggagggatttggggctcagagtggggtgggttgggagaatgtcagtatgtggaagtgtgggtctgtgtgtgtgtgtgtgtctgtgtgtgtgtgtgtgtgtgttgtgtgtgggagtgtgtaatttaaaattgtgatgtgtcctgataagccgagctccttagcctttgtccctagaatgcctcctgcaggggattcttcctgcttagcttgagggtgactatggagctaagcaggtgttcttcattacctcagtgagaagccagcttttctcatcaggccattgtccctgaagagaagggcagggctgagacctctcattccagaggaagggacgccaaaccttggctctaccctgagttcataagtttatggttcttgggcctgactctcagcagctatagtaggaactgctgtgcttggcagcccaggtcatctgtacctctgcctcctttcccctccctcaggctgaaggaggagtcagggagagctgaactatcagagctgcctgtgccttttgccatcccctcaacccagctatgtttctctcgcaagggaagtccttgcaacctaattctttgacctgttgggagtgaggatgtccgggccactcagggtcattcatggcctgggggatgtaccagcatctcctagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggcacccttccggccttctgtccctcgttcatagcacctccacatacccagccctgtgccttggtgtgctgtatccacccatggggctgattgtatttacctactacctcttggctgccttgtgaaggaattattcccatgagttggctgggaataagtgccaggatggaatgatgggtcagttgtaccagcatgtgtggcctgttcttctatgggttggacaacctcattttaactcagtctttaatctgagaggccacagtgcaattttattttatttttctcatgatgaggttttcttaacctaaaggaatatgtatataaacatgcttgcgttatgtttctaaatttatatgatggcaaagaaggagagcataggaagccacacagacttgggcagggtacagacactcccacttggcatcattcacagcaagtcactgtccagtggctgtatctgtgaggggctctctcatgatagaaggctatagggatagatgtatggacacattggacccttcctgaggaggagggactgttcttttgtctcagaaaagcagtggctccattggtgttgacatacatccaacattaaaagccacccccaatcgcccaagagaaaaagaaagccttatcaacagttgttccatgagcagaaaacaggagttctgatctcagtgttgcagctaaataatctttaactctaattaaggcaagtcactttcttcttc

SEQ ID NO: 84 - protein, 788 aa, Macaca mulatta
MRAQPGPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLSLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSRHCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 85 - DNA, 4480 bp, Macaca mulatta
  CDS (11)..(2377)
ggcggacgagatgcgagcgcagcccgggccccggccgctctgggcaactgtgctggcgctgggggcgctggcgggcgttggcgttgcagggcccaacatctgtaccacacgaggtgtgagctcctgccagcagtgcctggctgtgagccccatgtgtgcctggtgctctgatgaggccctgcctctgggctcacctcgctgtgacctgaaggagaatctgctgaaggataactgtgccccggaatccatcgagttcccagtcagtgaggcccgagtactagaggacaggcccctcagcgacaaaggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggacgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgtcgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcttcgcacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctctcccagaaaaacatcaatttgatctttgcagtgactgaaaatgtagtcaatctctatcagaactatagtgagctcatcccagggaccacagtcggggttctgtccatggattccagcaatgtcctccagctcattgttgatgcttatgggaaaatccgctctaaagtcgagctggaagtgcgtgacctccctgaagaattgtctctatccttcaacgccacctgcctcaacaatgaggtcatccctggcctcaagtcttgtatgggactcaagattggagacacggtgagcttcagcattgaggccaaggtgcgaggctgcccccaggagaaggagaagtcctttaccatcaagcccgtgggcttcaaggacagcctgatcgtccaggtcacctttgattgcgactgtgcctgccaggcccaagctgaacctaatagccgtcactgcaacaatggcaatgggacctttgagtgtggggtgtgccgttgtgggcctggctggctaggatcccagtgtgagtgctcagaggaggactatcgcccttcccagcaggacgagtgcagcccccgggagggtcagcccgtctgcagccagcggggcgagtgtctctgtggtcaatgtgtctgccacagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgcaccacacgtactgatacctgcatgtccagcaatgggctgctgtgcagcggccgcggcaagtgtgaatgtggcagctgtgtctgtatccagccgggctcctatggggacacctgtgagaagtgccctacctgcccagatgcctgcacctttaagaaagaatgcgtagagtgtaagaagtttgaccggggagccctacatgatgaaaatacctgcaaccgttactgccgcgatgagattgagtcagtgaaagagcttaaggacactggcaaggatgcagtgaattgtacctataagaatgaggatgactgtgtcgtcagattccagtactatgaagactctagtggaaagtccatcctgtatgtggtagaagagccagagtgtcccaagggccctgacatcctggtggtcctgctgtcagtgatgggggccattctgctcatcggccttgccactctgctcatctggaagctcctcatcaccatccacgaccgaaaagagtttgctaaatttgaggaagaacgcgccagagcaaaatgggacacagccaacaacccactgtataaagaggccacgtctaccttcaccaatatcacctaccggggcacttaatgataagcagtcatcctcagatcattatcagcctgtgccacgattgcaggagtctccgccatcatgtttacagaggacagtatttgtggggagggatttggggctcagagtggggtgggttgggagaatgtcagtatgtggaaatgtgggtctgtgtgtgtgtgtgtgtgtgtctgtgtgtgtgtgtgtgttgtgtgtgggagtgtgtaatttaaaattgtgatgtgtcctgataagccgagctccttagcctttgtccctagaatgcctcctgcaggggattcttcctgcttagcttgagggtgactatggagctaagcaggtgttcttcattacctcagtgagaagccagcttttctcatcaggccattgtccctgaagagaagggcagggctgagacctctcattccagaggaagggatgccaaaccttggctctaccctgagttcataagtttatggttcttgggcctgactctcagcagctatagtaggaactgctgtgcttggcagcccaggtcatctgtacctctgcctcctttcccctccctcaggctgaaggaggagtcagggagagctgaactatcagagctgcctgtgccttttgccatcccctcaacccagctatgtttctctcacaagggaagtccttgcaacctaattctttgacctgttgggagtgaggatgtccgggccactcagggtcattcatggcctgggggatgtaccagcatctcctagttcataatcacaacccttcagatttgccttattggcagctctactctggaggtttgtttagaagaagtgtgtcacccttaggccagcaccatctccttacctcctaattccacaccctcactgctgtagacatttgctatgagctggggatgtctctcatgaccaaatgcttttcctcaaagggagagagtgctattgtagagccagaggtctggcacccttccggccttctgtccctcgttcatagcacctccacatacccagccctgtgccttggtgtgctgtatccacccatggggctgattgtatttacctactacctcttggctgccttgtgaaggaattattcccatgagttggctgggaataagtgccaggatggaatgatgggtcagttgtaccagcatgtgtggcctgttcttctatgggttggacaacctcattttaactcagtctttaatctgagaggccacagtgcaattttattttatttttctcatgatgaggttttcttaacctaaaggaatatgtatataaacatgcttgcgttatgtttctaaatttatatgatggcaaagaaggagagcataggaagccacacagacttgggcagggtacagacactcccacttggcatcattcacagcaagtcactgtccagtggctgtatctgtgaggggctctctcatgatagaaggctatagggatagatgtatggacacattggacccttcctgaggaggagggactgttcttttgtctcagaaaagcagtggctccattggtgttgatatacatccaacattaaaagccacccccaatcgcccaagagaaaaagaaagccttatcaacagttgttccatgagcagaaaacaggagttctgatctcagtgttgcagctaaataatctttaactctaattaaggcaagtcactttcttcttcttaaggctgttttctagtttgagaaatgggttttgagcagccagtcttgaaggtctctttcagtatcaacattctaagatgctgggacttactgtggcatcaaatgtgtggtcaagattctgtgggatattgatactgtgtgtgttttcagttgggagatctgagagacctggctttggcaagagcagatgtcattccatatcacctttctcaatgaaagtctcattctatcctctctccaaaccccttttccaacatttgttaatagttatgtctctcctgatgtagcacttaagcttcatttagctattatttctttcttcactttgcacacatttgcatccacatattagggaagaggaatccataagcagctgaaatatctattctgtattcttgtgttaacattgagaataagc

SEQ ID NO: 86 - protein, 788 aa, Macaca mulatta
MRAQPGPRPLWATVLALGALAGVGVAGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLSLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSRHCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 87 - DNA, 2636 bp, Pan troglodytes
  CDS (30)..(2396)
cgggcggagcgccgcgggaggcggacgagatgcgagcgcggccgcggccccggccgctctgggcgactgtgctggcgctgggggcgctggcgggcgttggcgtcggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccagctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcaaaaacccctgctatgatatgaagaccacctgcttgcccatgtttggctataaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcccaatgacgggcagtgtcatgttggtagtgacaatcattactctgcctccactaccatggattatccctctttggggctgatgactgagaagctatcccagaaaaacatcaatttgatatttgcagtgactgaaaatgtagtcaatctctatcagaactatagtgagctcatcccagggaccacagttggggttctgtccatggattccagcaatgtcctccagctcattgttgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaagctcctcatcaccatccacgaccgaaaagagttcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttgggactcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataa

SEQ ID NO: 88 - protein, 788 aa, Pan troglodytes
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALQLRPDDSKNFSIQVRQVEDYPVDIYYLMDLSYSMKDDLWSIQNLGTKLATQMRKLTSNLRIGFGAFVDKPVSPYMYISPPEALKNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 89 - DNA, 2535 bp, Pan paniscus
  CDS (70)..(2295)
gttgcagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcccaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcctgtgggcttcaaggacagcctgatcgtccaggtcacctttgattgtgactgtgcctgccaggcccaagctgaacctaatagccatcgctgcaacaatggcaatgggacctttgagtgtgggatatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaagctcctcatcaccatccacgaccgaaaagagttcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataa

SEQ ID NO: 90 - protein, 741 aa, Pan paniscus
MCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGICRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 91 - DNA, 2613 bp, Pongo abelii
  CDS (30)..(2396)
cgggcggagcgccgcgggaggcggacgagatgcgagcgcggccgcggccccggccgctctgggcgactgtgctggcgctgggggcgctggcgggcgttggcgtcggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccctggaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgctatcatgcaggctacagtctgtgatgaaaagattggctggaggaatgacgcatcccacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagtcggggttctgtccatggattccagcaatgtcctccagctcattgtcgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaagtgcgaggctgtccccaggagaaggagaagtcctttaccatcaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcagtgtgtctgccacagcagtgactttggcaagatcacgggcaagtactgcgagtgtgatgacttctcctgtgtccggtacaagggggagatgtgctcaggccatggccagtgcagctgtggggactgcctgtgtgactctgactggaccggctactactgcaactgtaccacacgtactgacacctgcatgtccagcaatgggctgctgtgcagcggccgcggcaagtgtgaatgtggcagctgtgtctgtatccagccaggctcctatggggacacctgtgagaagtgccccacctgcccagatgcctgcacctttaagaaagaatgtgtggagtgtaagaagtttgatcggggagccctacatgacgaaaatacctgcaaccgttactgccgtgatgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcatcggccttgccgctctgctcatctggaagctcctcatcaccatccacgaccgaaaagagttcgctaaatttgaggaagaacgcgccagagcaaaatgggacacagccaacaacccactgtataaagaggccacatctaccttcaccaatatcacgtaccggggcacttaatgataagcagtcatcctcagatcattatcagcctgtgccacgattgcaggaatctctgccatcatgtttacagaggacagtatttgtggggagggatttgtgggatgggttgggagaatgtcagtatgtggaagtgtgggtctgtgtgtgtgtgtgtgggtctgtgtgtgtatgtgtgtgggagtgtgtaatttaaaattgtgatgtgtcctgataa

SEQ ID NO: 92 - protein, 788 aa, Pongo abelii
MRARPRPRPLWATVLALGALAGVGVGGPNICTTRGVSSCQQCLAVSPMCAWCSDEALPLGSPRCDLKENLLKDNCALESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 93 - DNA, 2613 bp, Pongo abelii
  CDS (30)..(2396)
cgggcggagcgccgcgggaggcggacgagatgcgagcgcggccgcggccccggccgctctgggcgactgtgctggcgctgggggcgctggcgggcgttggcgtcggagggcccaacatctgtaccacgcgaggtgtgagctcctgccatcagtgcctggctgtgagccccatgtgtgcctggtgctctgatgaggccctgcctctgggctcacctcgctgtgacctgaaggagaatctgctgaaggataactgtgccctggaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgctatcatgcaggctacagtctgtgatgaaaagattggctggaggaatgacgcatcccacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagtcggggttctgtccatggattccagcaatgtcctccagctcattgtcgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaagtgcgaggctgtccccaggagaaggagaagtcctttaccatcaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcagtgtgtctgccacagcagtgactttggcaagatcacgggcaagtactgcgagtgtgatgacttctcctgtgtccggtacaagggggagatgtgctcaggccatggccagtgcagctgtggggactgcctgtgtgactctgactggaccggctactactgcaactgtaccacacgtactgacacctgcatgtccagcaatgggctgctgtgcagcggccgcggcaagtgtgaatgtggcagctgtgtctgtatccagccaggctcctatggggacacctgtgagaagtgccccacctgcccagatgcctgcacctttaagaaagaatgtgtggagtgtaagaagtttgatcggggagccctacatgacgaaaatacctgcaaccgttactgccgtgatgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcatcggccttgccgctctgctcatctggaagctcctcatcaccatccacgaccgaaaagagttcgctaaatttgaggaagaacgcgccagagcaaaatgggacacagccaacaacccactgtataaagaggccacatctaccttcaccaatatcacgtaccggggcacttaatgataagcagtcatcctcagatcattatcagcctgtgccacgattgcaggaatctctgccatcatgtttacagaggacagtatttgtggggagggatttgtgggatgggttgggagaatgtcagtatgtggaagtgtgggtctgtgtgtgtgtgtgtgggtctgtgtgtgtatgtgtgtgggagtgtgtaatttaaaattgtgatgtgtcctgataa

SEQ ID NO: 94 - protein, 788 aa, Pongo abelii
MRARPRPRPLWATVLALGALAGVGVGGPNICTTRGVSSCHQCLAVSPMCAWCSDEALPLGSPRCDLKENLLKDNCALESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 95 - DNA, 4279 bp, Orcinus orca
  CDS (24)..(2378)
gagcgcggcggccagcggacgagatgcgagcgctgccgctgtgggccgctgtgctggtgctgggagcgctggcgggcgtcggcgtcggagggcccaacatctgtgccacacgaggcgtgagctcctgccagcaatgtctggctgtgagtcccatgtgtgcctggtgctctgatgaggctctgcctccgggctcgccccgctgtaacctgaaggagaatctgctgaaggatgactgcgccctggagtccatcgagttccccatcagcgaggccagaatcctggaggccaggcccctcagtgacaagggctctggagacagctcccagatcactcaagtcagtccccagaggattgcactccggctacggccagatgattcgaagaatttctccgtccaagttcggcaggtggaggattaccctgtggacatctactacttaatggacctgtcttattccatgaaggatgatctgtggagcatccagaacctgggtaccaagctggcctcccagatgcgtaagctcaccagtaacctgcggattggcttcggggcctttgtggacaagcccgtttcaccatacatgtacatctccccaccagaggccctcagaaacccctgctatgatatgaagaccacctgtttgcccatgtttggctacaaacacgtgctgacgctaactgaccaggtgacccgtttcaatgaggaggtgaagaagcagagtgtgtcacgaaaccgagatgccccagagggtggctttgatgccatcatgcaggctaccgtctgtgatgagaagattggctggaggaatgatgcctcccacttgctggtgtttaccactgatgccaagacccatatagcgctggatggaaggctggcaggcatcgtccagcccaacgatgggcagtgtcacgtgggcagtgacaaccattatgctgcctccactaccatggattatccctctctggggctgatgaccgagaagctgtcccagaaaaacatcaatttgatctttgcagtgactgaaaatgtagtcaatctctaccagaactatagtgagctcatcccagggaccacagtgggggtcctgtctactgattccagcaatgtccttcagctcattgttgatgcttacgggaaaatccgctctaaagtagagctggaagtgcgtgacctccctgaggagttgtccttatccttcaacgccacctgtctcaacaacgaggtcatcccaggccttaagtcttgtgtcggactcaagattggagacacggtgagcttcagcattgaggccaaggtgcgtggctgcccccaggagaaggagaagtccttcaccatcaagcctgtgggcttcaaagacagcctcaccgtccaggtcaccttcgactgtgactgtgcctgccaggcccaggctgagcctcagagccaccactgcaacaacggcaacgggacctttgagtgtggggtgtgccgctgcgggcctggctggctggggtcccagtgtgagtgctcagaagaggactaccgtccctcccagcaggacgagtgtagcccccgggagggccagcccatctgcagccagcggggcgagtgtctctgtggccagtgcgtctgccatagcagtgactttggcaagatcacgggcaagtactgtgagtgtgatgacttctcctgtgtccgctacaagggggagatgtgctcaggccatggccagtgcagctgtggggactgcctgtgtgactccgactggaccggctactactgcaactgtacgacacgcacggacacctgcatgtccagcaatgggctgctgtgcagcgggcggggcaagtgtgaatgcggcagctgcgtctgcatccagccgggctcctacggggacacctgtgagaagtgtcccacctgccctgatgcctgcacctttaagaaggagtgtgtggagtgtaagaagtttaaccgaggagccctatacgaggagaatacctgcagccgctactgccgtgatgagatcgagcctgtgaaggagcttaaggacactggaaaggatgctgtgaattgtacctacaagaatgaggaggactgtgtcgtcagattccagtactatgaagactccagtggaaagtccatcctgtatgtggtagaagagcccgagtgtcccaagggccctgacatcctggtggtcctgctttcagtgatgggggccattctgctcatcggccttgctactctgctcatctggaagctcctcattaccatccatgaccggaaggagtttgctaaatttgaggaggagagagccagagccaaatgggacacagccaacaacccactgtataaagaggccacgtccaccttcaccaacatcacctatcggggcacttaatgacaggcagtcatcctcagatcactatcagactgtcccaggattgtgggtgtctctgctgtcgtgtttacaggggcaatacctgtggggcagaattgggggcttggagtggggtgggttggaagaatgtgggtctctgtgcgtgtgtgcatgtgagtgtgctgcgtgtgggagagtgtgtaacttaaaacttgtgatgtgtcccagataagcagagctcctcgcctttgtcctcagaacgcctccttcagggagtctacctgcttaacctgagggtgacctagtagctgagcaggtattcttcattacctcagtgggaagccagctttccttctcaggccattctcttaaagaggagggcagggccaaggcctctcatttcagagaaagggaccttggtttaccctgtgtttgtggttcttgggcctgactctcagcagctctggtaggaactgccaggctttgcagccttgctgtgtcatccatgcccctagctcctctcccttccctcaggcagaaggagaaatccggggagagctgaaccatcagagctgcctgtctttgccatcacctcaatccagcatggttctctcctaaaggaagtccttgctacctattcttcggtctgttgagagtgagaacggcagggtcacccacgggtcatgcatggcctggggttaaggtgcccgagttccccagttcataatcctaacccttcagatttgcctcattgacagctctaccctagtgattcgtgtagaaaaagtgtgtcacccttagaccagcaacacctctttacctcctattccaccctttcactactatagacatttgctacatacggggaatttctctcatgaccagaagcttttccttccagggagagtgccatggttagagccagaggtctggcctcacccttcaggccttctgtctcgtgtccaaggcacctccacacacccaaccctgtgcttctgtgtgctacgtccacccatggggctgattgcatttatctacctcttgggtgtcttgtgaaggcgtcattcccacgggtctttgagtctgctgggcataagtgccagggtggaatgacgggccagtcgtatcagcgtgtgtggcccatcctcctgtgggccgggcaacctcatttaactcagtctttaatctgagaggccacaagtgcaattttgttttatttttctcattggggcacctgaaaccatgatgaggcttgtttaatctaaaggagcatagatataaacacacttgcattatatttgtaattttatttgatgatgaagaaaagggtgaaaagccacacagacctgggctggatgcagacactcccacttagcgtcattcatagcaagttgctgcccagttgctgggtctgtaagggctctctcatccctgaagcctgcggggatggacacgtggacatgctggaccttgcccaagcaggaggaggtaaatgggctgttctttttttctagcaaaagcagaaaaactccattggtgtttacattcgttcaacgttaaccaccaccaccactccccaagaaaaagggaggggcctaaaaacagtggtctgatggtcagaaaatctaagtcctggcctcagtgttgcagctaaggaactttaaccttaattaaggcaagttactttctttttcctggggctcagttttctagtttgaaaaatgatgggtttggaccagccagtctaggcagtctctttcagtgtcaacagtctgtgatgctgggacttactgtggcatcaaacatgcagtcaggattctgtgggatgttgatactgtttgttttttcagttgggagacctggctctggcaagagcagatgtcatcccatatcacctttctcaatgaaaaagcttcattctg

SEQ ID NO: 96 - protein, 784 aa, Orcinus orca
MRALPLWAAVLVLGALAGVGVGGPNICATRGVSSCQQCLAVSPMCAWCSDEALPPGSPRCNLKENLLKDDCALESIEFPISEARILEARPLSDKGSGDSSQITQVSPQRIALRLRPDDSKNFSVQVRQVEDYPVDIYYLMDLSYSMKDDLWSIQNLGTKLASQMRKLTSNLRIGFGAFVDKPVSPYMYISPPEALRNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYAASTTMDYPSLGLMTEKLSQKNINLIFAVTENVVNLYQNYSELIPGTTVGVLSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTVQVTFDCDCACQAQAEPQSHHCNNGNGTFECGVCRCGPGWLGSQCECSEEDYRPSQQDECSPREGQPICSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFNRGALYEENTCSRYCRDEIEPVKELKDTGKDAVNCTYKNEEDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 97 - DNA, 3033 bp, Orcinus orca
  CDS (70)..(2295)
gttacagggcccaacatctgtgccacacgaggcgtgagctcctgccagcaatgtctggctgtgagtcccatgtgtgcctggtgctctgatgaggctctgcctccgggctcgccccgctgtaacctgaaggagaatctgctgaaggatgactgcgccctggagtccatcgagttccccatcagcgaggccagaatcctggaggccaggcccctcagtgacaagggctctggagacagctcccagatcactcaagtcagtccccagaggattgcactccggctacggccagatgattcgaagaatttctccgtccaagttcggcaggtggaggattaccctgtggacatctactacttaatggacctgtcttattccatgaaggatgatctgtggagcatccagaacctgggtaccaagctggcctcccagatgcgtaagctcaccagtaacctgcggattggcttcggggcctttgtggacaagcccgtttcaccatacatgtacatctccccaccagaggccctcagaaacccctgctatgatatgaagaccacctgtttgcccatgtttggctacaaacacgtgctgacgctaactgaccaggtgacccgtttcaatgaggaggtgaagaagcagagtgtgtcacgaaaccgagatgccccagagggtggctttgatgccatcatgcaggctaccgtctgtgatgagaagattggctggaggaatgatgcctcccacttgctggtgtttaccactgatgccaagacccatatagcgctggatggaaggctggcaggcatcgtccagcccaacgatgggcagtgtcacgtgggcagtgacaaccattatgctgcctccactaccatggattatccctctctggggctgatgaccgagaagctgtcccagaaaaacatcaatttgatctttgcagtgactgaaaatgtagtcaatctctaccagaactatagtgagctcatcccagggaccacagtgggggtcctgtctactgattccagcaatgtccttcagctcattgttgatgcttacgggaaaatccgctctaaagtagagctggaagtgcgtgacctccctgaggagttgtccttatccttcaacgccacctgtctcaacaacgaggtcatcccaggccttaagtcttgtgtcggactcaagattggagacacggtgagcttcagcattgaggccaaggtgcgtggctgcccccaggagaaggagaagtccttcaccatcaagcctgtgggcttcaaagacagcctcaccgtccaggtcaccttcgactgtgactgtgcctgccaggcccaggctgagcctcagagccaccactgcaacaacggcaacgggacctttgagtgtggggtgtgccgctgcgggcctggctggctggggtcccagtgtgagtgctcagaagaggactaccgtccctcccagcaggacgagtgtagcccccgggagggccagcccatctgcagccagcggggcgagtgtctctgtggccagtgcgtctgccatagcagtgactttggcaagatcacgggcaagtactgtgagtgtgatgacttctcctgtgtccgctacaagggggagatgtgctcaggccatggccagtgcagctgtggggactgcctgtgtgactccgactggaccggctactactgcaactgtacgacacgcacggacacctgcatgtccagcaatgggctgctgtgcagcgggcggggcaagtgtgaatgcggcagctgcgtctgcatccagccgggctcctacggggacacctgtgagaagtgtcccacctgccctgatgcctgcacctttaagaaggagtgtgtggagtgtaagaagtttaaccgaggagccctatacgaggagaatacctgcagccgctactgccgtgatgagatcgagcctgtgaaggagcttaaggacactggaaaggatgctgtgaattgtacctacaagaatgaggaggactgtgtcgtcagattccagtactatgaagactccagtggaaagtccatcctgtatgtggtagaagagcccgagtgtcccaagggccctgacatcctggtggtcctgctttcagtgatgggggccattctgctcatcggccttgctactctgctcatctggaagctcctcattaccatccatgaccggaaggagtttgctaaatttgaggaggagagagccagagccaaatgggacacagccaacaacccactgtataaagaggccacgtccaccttcaccaacatcacctatcggggcacttaatgacaggcagtcatcctcagatcactatcagactgtcccaggattgtgggtgtctctgctgtcgtgtttacaggggcaatacctgtggggcagaattgggggcttggagtggggtgggttggaagaatgtgggtctctgtgcgtgtgtgcatgtgagtgtgctgcgtgtgggagagtgtgtaacttaaaacttgtgatgtgtcccagataagcagagctcctcgcctttgtcctcagaacgcctccttcagggagtctacctgcttaacctgagggtgacctagtagctgagcaggtattcttcattacctcagtgggaagccagctttccttctcaggccattctcttaaagaggagggcagggccaaggcctctcatttcagagaaagggaccttggtttaccctgtgtttgtggttcttgggcctgactctcagcagctctggtaggaactgccaggctttgcagccttgctgtgtcatccatgcccctagctcctctcccttccctcaggcagaaggagaaatccggggagagctgaaccatcagagctgcctgtctttgccatcacctcaatccagcatggttctctcctaaaggaagtccttgctacctattcttcggtctgttgagagtgagaacggcagggtcacccacgggtcatgcatggcctggggttaaggtgcccgagttccccagttcataatcctaacccttcagatttgcctcattgacagc

SEQ ID NO: 98 - protein, 741 aa, Orcinus orca
MCAWCSDEALPPGSPRCNLKENLLKDDCALESIEFPISEARILEARPLSDKGSGDSSQITQVSPQRIALRLRPDDSKNFSVQVRQVEDYPVDIYYLMDLSYSMKDDLWSIQNLGTKLASQMRKLTSNLRIGFGAFVDKPVSPYMYISPPEALRNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYAASTTMDYPSLGLMTEKLSQKNINLIFAVTENVVNLYQNYSELIPGTTVGVLSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTVQVTFDCDCACQAQAEPQSHHCNNGNGTFECGVCRCGPGWLGSQCECSEEDYRPSQQDECSPREGQPICSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFNRGALYEENTCSRYCRDEIEPVKELKDTGKDAVNCTYKNEEDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 99 - DNA, 2374 bp, Canis lupus familiaris
  CDS (1)..(2355)
atgcgggcgcggccgctctgggccgcggtgctgctgctgggggcgctggcgggcaccggcgtcggagtgtccaacatctgtaccacacgaggtgtccactcctgccagcaatgtctagctgtgagtcctgtgtgtgcctggtgctcagatgaggccctgcctctgggctctccccgctgtaacctgaaggaaaatctgctgaaggataactgtgccctggaatccattgagttccccatcagtgaggtccgcatcctggaggccaggccccttagcaacaagggctctggagacagctcccagattactcaagtcagccctcagaggattgcgctgcggctccggccagatgattcaaagaatttctccatccaagttcggcaagtagaggattaccctgtggacatctactacttgatggacctgtcttattccatgaaggatgatctgtcgagcatccagaacctaggcaccaggctggcctcccagatgcacaagctcaccagtaacttgcggattggcttcggggcttttgtggacaagcctgtgtctccatacatgtacatctccccaccagaggccctcaaaaacccctgctatgatatgaagaccacctgtttgcctatgtttggctacaaacatgtgctgacgctaactgaccaggtgacccgcttcaatgaggaagtgaaaaagcagagtgtgtcacggaaccgagatgccccagagggcggctttgatgctatcatgcaggctacagtctgtgatgagaagattggctggaggaatgatgcatcccacttgctggtatttaccactgatgccaagacccatatagcgctggatggaaggctggcaggcattgtccaacctaacgatgggcagtgtcacattggcagtgacaaccattattctgcctccactaccatggattatccctctctgggactgatgacagagaagctctcccagaaaaacatcaatttgatctttgcagtaacggaaaatgtggtcaatctctaccagaactacagtgagctcatcccagggaccacagtggggattctgtctacggattccagcaatgtccttcagctcattgttgatgcttatggaaaaatccgctctaaagtggagctggaagtgcgtgacctccctgaggagttgtctctatcgttcaacgccacctgtctcaacaatgaggtcatcccgggcctcaagtcttgtgtcggcctcaagattggagacacggtgagcttcagcattgaggccaaagtgcgaggctgcccccaggagaaggagaagtccttcaccatcaagcctgtgggcttcaaagacagcctcaccatccaggtcacctttgactgtgactgtgcctgccaggcccaggctgagccttccagtcaccgctgcaacaatggcaatgggacctttgagtgtggggtgtgcctctgtgggcctggctggctggggtcccagtgtgaatgctcggaagaggactatcatccctcccagcaggacgagtgcagcccccgggagggccagcccgcctgcagccagcggggcgagtgcctgtgtggccaatgtgtctgccatagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgtaccacgcgcactgacacgtgcatgtccagcaacgggctgctgtgcggcggtcggggcaagtgtgagtgtggcagctgcgtgtgcatccaacctggctcctacggggacacctgcgagaagtgccccacctgccctgacgcctgcacctttaagaaggagtgtgtggagtgtaagaaatttgaccgaggaactctccatgatgataatacctgcaaccgttactgtcgtgatgagattgagtctgtgaaggagcttaaggatactggcaaggatgcagtgaattgtacatacaagaatgaggatgactgtgttgtcagatttcagtactatgaagactccagtggaaagtccattctctatgtggtagaagagccagagtgtcccaagggtcctgacatcctggtggtcctgctttcagtgatgggggccattttgctcattggccttgctactctgctcatctggaagctcctcatcaccatccatgatcggaaggagtttgctaaatttgaggaagagcgagccagagcaaaatgggacacagccaacaacccactgtataaagaggccacatccacttttaccaacatcacctaccggggcacttaacaccaaggagccatcctca

SEQ ID NO: 100 - protein, 784 aa, Canis lupus familiaris
MRARPLWAAVLLLGALAGTGVGVSNICTTRGVHSCQQCLAVSPVCAWCSDEALPLGSPRCNLKENLLKDNCALESIEFPISEVRILEARPLSNKGSGDSSQITQVSPQRIALRLRPDDSKNFSIQVRQVEDYPVDIYYLMDLSYSMKDDLSSIQNLGTRLASQMHKLTSNLRIGFGAFVDKPVSPYMYISPPEALKNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHIGSDNHYSASTTMDYPSLGLMTEKLSQKNINLIFAVTENVVNLYQNYSELIPGTTVGILSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTIQVTFDCDCACQAQAEPSSHRCNNGNGTFECGVCLCGPGWLGSQCECSEEDYHPSQQDECSPREGQPACSQRGECLCGQCVCHSSDFGKITGKYCECDDFSCVRYKGEMCSGHGQCSCGDCLCDSDWTGYYCNCTTRTDTCMSSNGLLCGGRGKCECGSCVCIQPGSYGDTCEKCPTCPDACTFKKECVECKKFDRGTLHDDNTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 101 - DNA, 5284 bp, Canis lupus familiaris
  CDS (28)..(2370)
ggagaagtagcagaactagagtgctggatgccaaggaggtcaccaacagggcactgctgggctgagcctcaaacagagcttgtgtccaacatctgtaccacacgaggtgtccactcctgccagcaatgtctagctgtgagtcctgtgtgtgcctggtgctcagatgaggccctgcctctgggctctccccgctgtaacctgaaggaaaatctgctgaaggataactgtgccctggaatccattgagttccccatcagtgaggtccgcatcctggaggccaggccccttagcaacaagggctctggagacagctcccagattactcaagtcagccctcagaggattgcgctgcggctccggccagatgattcaaagaatttctccatccaagttcggcaagtagaggattaccctgtggacatctactacttgatggacctgtcttattccatgaaggatgatctgtcgagcatccagaacctaggcaccaagctggcctcccagatgcacaagctcaccagtaacttgcggattggcttcggggcttttgtggacaagcctgtgtctccatacatgtacatctccccaccagaggccctcaaaaacccctgctatgatatgaagaccacctgtttgcctatgtttggctacaaacatgtgctgacgctaactgaccaggtgacccgcttcaatgaggaagtgaaaaagcagagtgtgtcacggaaccgagatgccccagagggcggctttgatgctatcatgcaggctacagtctgtgatgagaagattggctggaggaatgatgcatcccacttgctggtatttaccactgatgccaagacccatatagcgctggatggaaggctggcaggcattgtccaacctaacgatgggcagtgtcacattggcagtgacaaccattattctgcctccactaccatggattatccctctctgggactgatgacagagaagctctcccagaaaaacatcaatttgatctttgcagtaacggaaaatgtggtcaatctctaccagaactacagtgagctcatcccagggaccacagtggggattctgtctacggattccagcaatgtccttcagctcattgttgatgcttatggaaaaatccgctctaaagtggagctggaagtgcgtgacctccctgaggagttgtctctatcgttcaacgccacctgtctcaacaatgaggtcatcccgggcctcaagtcttgtgtcggcctcaagattggagacacggtgagcttcagcattgaggccaaagtgcgaggctgcccccaggagaaggagaagtccttcaccatcaagcctgtgggcttcaaagacagcctcaccatccaggtcacctttgactgtgactgtgcctgccaggcccaggctgagccttccagtcaccgctgcaacaatggcaatgggacctttgagtgtggggtgtgcctctgtgggcctggctggctggggtcccagtgtgaatgctcggaagaggactatcatccctcccagcaggacgagtgcagcccccgggagggccagcccgcctgcagccagcggggcgagtgcctgtgtggccaatgtgtctgccatagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgtaccacgcgcactgacacgtgcatgtccagcaacgggctgctgtgcggcggtcggggcaagtgtgagtgtggcagctgcgtgtgcatccaacctggctcctacggggacacctgcgagaagtgccccacctgccctgacgcctgcacctttaagaaggagtgtgtggagtgtaagaaatttgaccgaggaactctccatgatgataatacctgcaaccgttactgtcgtgatgagattgagtctgtgaaggagcttaaggatactggcaaggatgcagtgaattgtacatacaagaatgaggatgactgtgttgtcagatttcagtactatgaagactccagtggaaagtccattctctatgtggtagaagagccagagtgtcccaagggtcctgacatcctggtggtcctgctttcagtgatgggggccattttgctcattggccttgctactctgctcatctggaagctcctcatcaccatccatgatcggaaggagtttgctaaatttgaggaagagcgagccagagcaaaatgggacacagccaacaacccactgtataaagaggccacatccacttttaccaacatcacctaccggggcacttaacaccaaggagccatcctcagatcactatcagtctgtcccagaattgtggacatctctgctgtcatgtttacagggaacagtatctgtggggcgggattgggggctggttgtggggtgggttggaggaatggcagcatgcggaggtgtggctctgtgtgtgtgtgtgtgtgtctgtgtgagtgtgttgcgtgtgggggaatgtgtaatttaaagtttgtggtgtgtcccaggtcagcggaactcctcagcctttatccacagaatgcctccttcagggatctttcctgcttaacctgagggtgacatagctgagcaggtgttcattacctcagtgagaagccagctctcctttccaggccattttttctgaagagaagggcagggctgagtctctcattccagaggaagcggccttgattctactttgagtttatggttctcaggcctgactctcagtggctctgatagcaactgctgggcttggcagtcttgtgtcagctaggcctttatctcctttcccttccctcaggctgaaggagaaatcagaggcaagctgaaccatcagagttgcctgtgccttttgccatcacctcaatccagtatggttccctcataaagggagtccttgctagcaattgtgttgggagtgaggatggtagggctactcaggggtcgtgcatggcctggatgaatgtgccagggtccccagttcataatcataacccttaagatttgtctcattggcagctccaccctagaagttcgtttagaagtgcgtcacccttagaccagcatcacttctttaccttccacttccacactctcactgctgtaaacatactgggaatttctttcatgaccaaatgcttttcctcccagggtgagtgctacgattagagcccgaggtctggccccactcttcaggccctccccgccttgtccaaggcacctccacacacccaacctggtgctaacgtgtggtacattcatccatgcggctgattacatttatctacctcttggctgtcttgtgaatgaatagttcccatgggtctctgagtctgatgggaataagtgccacatttggaatgatggaccagttgtatcagcatgtgtggcctattctcctatgggctgggcaacctcattttaactcagtctttaatttgggaggctgtgactgcaattttattttattttttcattgggtcacctgaaaccatgatgaggcttgtttaatctaaaggaatatgtatataaacacactcgcatatacttgtaattttatttgatggtgaggagggagaatattaaaaaaaaaacaaaacctacacagacttggactggatacaaaccctcccacttggcatcattcatagcaagttgctgctcagttgctaggtctgtaagggctctctcattctggaagcctttggggatggacccatgggcatgttgggctctttctaaggagatggaatacaggctgttcttttttcctagccataacagttgctccgttggtgtttaccttagtctaacattaacaactatcttcactgccattcatcaagaaaaagggaaggacctatacacagtggtctgatgatcagagaaatctaagccctagcctcagtgttgcagctaaggaatttttaacttcgattaaggcaagtctccctggggctcaattttctagtttgaaaaatggtaggcttggaccagccactctagaaggtctcttacagtattgatattctaagatgctgggacttcctgagacatcaaacgtacagtcaagattctgtgagatgttgttactatttgttgttatagttgggagatctgagagacctggctttgacaagcgcagatatcattccatatcacctttcccaatgaaagagcctcattctatcctctcttagaaccccttccccaacatttttttttattttcattgatgtttttttaataataaatttattttttattggtgttcaatttgccaacatacagaaaaacacccagtgcccttcctcaacatttgttagcagttacatctcctgatgtagcactcaagctccacttagtttattatttcctagttcactttgcacacatttgcatccatgcatatggaagaggcatccgtaagaagtagctgaaatatatattctgtattcatgtgttaacattgagaataagccttggaattagaaatggggcaaatgactgagccttgtctcacccatggattaccctttagtgaaggggatggaagtgcagtagagggatggtagtacagtagagggttgggtccaagaaatttcaaacctaactatatcctttggctactgagacaagagtctattagagtagtagttggacattttatttagataagatggtttatatgaagaaactatatcaaaagaggaagaacatatatttataagattaaaataatcagtaggactcttgtctgagcttctggaacgaggcttctaggttttaaaagaccaatactctttgtctgtatatggggagaacctgttcacgagatagcaaagaaaagtcagttttggcatcacatggggtgaacatctaaatagtattttggcatcagcacagccccaaaaggttattattcatgctcagctcctctggaaataatttatgttcaatctcagggtctgtggacagtaatgggaagctctgaacgttccttacaagttgtcccataaggagtcagttctttacctctcagatattcttagaccatccatgacttcaagatacttttctttgttaagtattcctggttgaaatgacttaagtgccttcctgacttcccagccacccctctgtttgagttgtgcaacagtgaattaaatgtgttttccaaaacgaa

SEQ ID NO: 102 - protein, 780 aa, Canis lupus familiaris
MPRRSPTGHCWAEPQTELVSNICTTRGVHSCQQCLAVSPVCAWCSDEALPLGSPRCNLKENLLKDNCALESIEFPISEVRILEARPLSNKGSGDSSQITQVSPQRIALRLRPDDSKNFSIQVRQVEDYPVDIYYLMDLSYSMKDDLSSIQNLGTKLASQMHKLTSNLRIGFGAFVDKPVSPYMYISPPEALKNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHIGSDNHYSASTTMDYPSLGLMTEKLSQKNINLIFAVTENVVNLYQNYSELIPGTTVGILSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTIQVTFDCDCACQAQAEPSSHRCNNGNGTFECGVCLCGPGWLGSQCECSEEDYHPSQQDECSPREGQPACSQRGECLCGQCVCHSSDFGKITGKYCECDDFSCVRYKGEMCSGHGQCSCGDCLCDSDWTGYYCNCTTRTDTCMSSNGLLCGGRGKCECGSCVCIQPGSYGDTCEKCPTCPDACTFKKECVECKKFDRGTLHDDNTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 103 - DNA, 2739 bp, Equus caballus
  CDS (1)..(2355)
atgcgagcgcggctgctctgggccgcggtgctggtgctgggggcgctggcgggcgtcggcgtcggagggcccaacatctgcaccacacgaggtgtgagctcctgccggcagtgcctggctgcgagtcccatgtgtgcctggtgctcggatgcggccctgcctctgggctcaccccgctgtaacctgaaggagaatctgctgaaggataactgtgcgctggggtccatcgagttccctgtcagtgaggccatcatcctggaggccaggcccctcagcgacaagggctctggagacagctcccagattactcaagtcagcccccagaggattgcactccggctacggccagatgattcgaagaatttctccgtgcaagtccggcaggtggaggattaccccgtggacatctactacttgatggacctgtcttactccatgaaggatgatctggggagcatccagaacctgggtaccaagctggcctcccagatgcggaaactcaccagtaacctgcggattggctttggggcttttgtggacaagcctgtgtcaccatacatgtttatctccccaccagaggcccttaaaaacccctgttatgatatgaagaacgtgtgtttgcccatgtttggctacaaacatgtgctgacactaacagaccaggtgacccgcttcaatgaggaggtgaagaagcagagcgtgtcacggaaccgagatgccccagagggtggctttgatgcaatcatgcaggctacagtctgtgataagaagattggctggaggaatgatgcatcccacttgctggtgtttaccactgatgccaagacccatatagcactggatggaagactggcaggcattgtccagcccaatgatgggcagtgtcacattggcagtgacaaccattactctgcctctactaccatggattatccctctctggggctgatgaccgagaagctatcccagaaaaacatcaatttgatctttgcagtgactgaaaatgtcgtcaatctctaccagaactacagtgagctcatccccgggaccacagtgggagttctgtctaccgattctagcaatgtcctccagctcattgttgatgcttatggaaaaatccgctctaaagtagagctggaagtacgtgacctccctgaggagttgtctctatccttcaacgccacctgtctcaacaacgaggtcatcccaggcctcaagtcttgtgttggactcaagattggagacacggtgagcttcagcattgaggctaaggtacgtggctgccctcaggagaaggagaagtccttcaccatcaagcctgtgggcttcaaagacagcctcactgtccaggtcacctttgactgcgactgtgcctgccaggcctgggctgagccttacagccaccgctgcaacaatggcaacgggacctttgagtgtggggtgtgccgctgtgggcctggctggctcgggtcccagtgcgagtgctcagaagaggactaccgcccctcccagcaggacgagtgcagccctcgggagggccagcccatctgcagccagcggggcgagtgcctctgtggccagtgcgtctgccacaccagtgactttggcaagatcacgggcaagtactgcgagtgtgatgacttctcctgtgtccgctacaagggggagatgtgctcaggccatggccagtgcagctgtggggactgcctgtgtgactccgactggactggctactactgcaactgtaccacgcgcaccgacacctgcatgtccagcaacgggctgctgtgcagcggccggggcaagtgtgaatgtggcagctgcgtctgcatccagccgggctcctacggggacacctgtgagaagtgtcccacctgccctgatgcctgcacctttaagaaggagtgtgtggagtgtaagaagtttgagcggggagccctctacgaggagaatacctgcacccgttactgtcgtgatgagatcgagtctgtgaaggagcttatggatactggcaaggatgcagtgaattgtacctacaagaatgaggatgactgtgttgtcagattccagtattatgaagacgccagtggaaagtccatcctgtatgtggtagaagagccagagtgtcccaagggccctgacatcctggtggtccttctttcagtgatgggggccattctgctcatcggtcttgctactctgctcatctggaagctcctcatcaccatccatgaccggaaggaatttgctaaatttgaggaagagcgagccagagcaaaatgggacactgccaacaacccactgtataaagaggccacatccaccttcaccaacatcacctaccgaggcacttaacgacaagcagttgtcctcagatcactatcagactgtcccaggattgtgggtgtctctgctgtcatgtttacaggggacaatgtctgtggggtgggactgggggcttggactggggtgggttggaagaatgtcagtatgtggaagtgtgggtctgtgcatgtgtgcgtgtgagtgtgctgtgagaggaggaatgtgtaattgaaaacttgtgatgtgtcacagataagcggagctcctcagctttgtcctcagaatgcctccttcagggattcttcctgcttaacctgagagtgacccatgtagctgagcaggtgttcttttttacctcagtgagaagccagcttttcttctcgggccgttctccctgaagagaagggcaggctg

SEQ ID NO: 104 - protein, 784 aa, Equus caballus
MRARLLWAAVLVLGALAGVGVGGPNICTTRGVSSCRQCLAASPMCAWCSDAALPLGSPRCNLKENLLKDNCALGSIEFPVSEAIILEARPLSDKGSGDSSQITQVSPQRIALRLRPDDSKNFSVQVRQVEDYPVDIYYLMDLSYSMKDDLGSIQNLGTKLASQMRKLTSNLRIGFGAFVDKPVSPYMFISPPEALKNPCYDMKNVCLPMFGYKHVLTLTDQVTRFNEEVKKQSVSRNRDAPEGGFDAIMQATVCDKKIGWRNDASHLLVFTTDAKTHIALDGRLAGIVQPNDGQCHIGSDNHYSASTTMDYPSLGLMTEKLSQKNINLIFAVTENVVNLYQNYSELIPGTTVGVLSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTVQVTFDCDCACQAWAEPYSHRCNNGNGTFECGVCRCGPGWLGSQCECSEEDYRPSQQDECSPREGQPICSQRGECLCGQCVCHTSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFERGALYEENTCTRYCRDEIESVKELMDTGKDAVNCTYKNEDDCVVRFQYYEDASGKSILYVVEEPECPKGPDILVVLLSVMGAILLIGLATLLIWKLLITIHDRKEFAKFEEERARAKWDTANNPLYKEATSTFTNITYRGT

SEQ ID NO: 105 - DNA, 4990 bp, Felis catus
  CDS (78)..(2432)
ctcccgctgcgggaaaagtggccgcgggcgccgctactcgctgtggggcgggcgcggcggcggcggcggcggacgagatgcgagcgcggccgctctgggccgccgtgctggtgctgggggcgctggcgggcgtcggtgtcggagtgtccaacatctgtaccacacgaggcatccactcctgccaggagtgtctggctgtgagtcctgcgtgtgcctggtgctcagatgaggccctccctctgggctcgccccgctgtaacctgaaagagaatctgctgaaggataactgtgcgttggagtccgtcgagttccccgtcagtgaggcccgcatcttagaggccaggcccctcagcgacaagggctctggagacagctcccagattactcaagtcagcccccagaggattgcgctccggctccggccagatgattcgaagattttctccgtccgagtccggcaggtggaggattaccctgtggacatctactacttgatggacctgtcttactccatgaaggatgatctatggagcatccagaacctgggcaccaagctggcctcccagatgcgcaagctcaccagtaacttgcggattggctttggggcttttgtggacaagcctgtgtcaccatacatgtacatctcccctccagaggccctcaaaaacccctgctatgatatgaagaacacctgcttgcctatgtttggctacaaacatgtgctgacactaactgaccaggtgacccgcttcaatgaggaagtgaagaagcagagtgtgtcgcggaaccgagatgccccagagggtggctttgatgccatcatgcaggctacagtctgtgatgagaagattggctggaggaatgatgcctcccacttgctggtgtttaccactgatgccaagacccatattgcgctggatggaaggctggcaggcattgtccagcccaatgatgggcagtgccacgttggcagtgacaaccattactctgcctccactaccatggattatccctctctggggctgatgaccgagaagctatcccagaaaaacatcaatttgatctttgctgtaacggaaaatgtagtcagtctctaccagaactatagcgagctcatcccagggacgacagtgggggttctgtctgccaattccagcaacgtccttcagctcattgttgatgcttatgggaaaatccgctctaaagtagagctggaagtgcgggacctccccgaggagctgtctctatccttcaacgccacctgtctcaacaacgaggtcatccctggcctcaagtcttgtgtcggactcaagattggagacacggtgagcttcagcattgaggccaaggtgcgaggctgcccgcaggagagggagaagtccttcaccatcaagcctgtaggcttcaaagacagcctcaccgttcaggtcaccttcgactgtgactgtgcgtgccaggcccatgctgagccttacagccgccgctgcaacaatggcaacgggacctttgagtgtggggtgtgccgctgcgggcccgggtggctggggtcccagtgcgagtgctccgaagaggactaccgcccctcgcagcaggaagagtgcagcccccaggagggccagcccgcctgcagccagcggggcgagtgcctgtgtggccagtgcgtctgccacagcagtgactttggcaagatcacgggcaagtactgcgagtgtgatgacttctcctgcgtccgctataagggggagatgtgctcaggtcacggccagtgcagctgtggggactgtctgtgtgactccgactggaccggcttctactgcaactgcaccacgcgcaccgacacctgcatgtccagcaacgggctgctgtgcagcggccggggcaagtgtgagtgcggcagctgcgtgtgcatccagctcggctcctacggggacacctgtgagaagtgccccacctgccctgacacctgcacctttaagaaggagtgtgtggagtgtaagaaatttgaccggggagacctacgtaaagaaaatacctgcagccgttactgtcgtgatgagattgagtctgtgaaggagctcaaggatactggcaaggatgcagtgaactgcacgtacaagaatgaagatgactgtgttgtcagattccagtactatgaagactccagtggaaagtccattctctatgtggtagaggagccagagtgtcccaagggtcctgacatcctggtggtcctactctcagtgatgggggccattttgctcatcggccttgctactctgctcatctggaagctcctcatcaccatccatgaccggaaggagtttgctaaatttgaggaagagcgagccagagcaaaatgggacacagccaacaacccactgtataaagaggccacatccaccttcaccaacatcacctaccggggcacttaatgacaagcagtcatcctcagttcactgtcaggctgtcccagaattgtggacacatctgctgtcatgtttacagggaatgaaatctgtggggcaggatcgggggctgggagtggggtgggttccaagaatgtcagtatgtggaggtgtgggtctctgtgcgtgtgtacgcgtgagtgtgctgcatgtgggggagtgtgtaatttaaaacttgaggtgtgtccagacacgtggagctcctcagcctttgtccgcagaatgcctccttcagggatccttcctgcttaaccttagggtgacccacgtagctgagcaggtactgttcattacctcagtgagaagccagctttccttttccggccatttctcccaaagagaagggcagggctgagcctctcattccagaggaaggggccttgactctgccttgagtttacggttcttgggtccgacgctcagcagctctgatagcaaatgctgggctctgcagccttgttgtgtcatctggactttgatctcctttgccttccctcaggctgaaggagaaatcagaagcaagcggagccatcggagttgcctatgtcttttgctatcccctcaatccagtatggttctctcacaaggggagcccttgccagcaatcctgttgggagtgaggatgggaaggccactcaggggtcatgcatggcctggatgaatgtgccagagtcccccagttcataatcatcacccttcagatttgtctccttggcaccccaccctagaagttcgattggaggacgcgtgttacccttagaccagcatcacctctttaccttctacgtccacactctcactgctgtagacatttgctacatactgggaatttctttcatgaccggacgcttttcctcccagggagagtgctgtgatgagagccagagatctggccccacccttcaggccctctgccccttgtccaaggcacccccccgcccctacacccaatctggtgcttctgtgtgctacatccatccatggggctgattgcacttatctacctcttggctgtcttgtgaaggaatcattcccatgggtctctgagtctgctgggcatatgtgccacatttagaatgaggggccagttggatcagcgtgtgtggcctattctcctatgggctgggcaacctcattttaactcagtctttaatctgagaggccacaagtgcagttttattttatttttctcattgggtcacctgaaaccatgatgaggcttgcttaatctaaaggaatacgtacagaaacacctttgcattctattttgtagttttatttgaggaggaggagcatatttaaaaaaaaaaaaaaacaacaaccccacacagacttgggatggatacagaccctcccacttggcatcattcatagggagttgctgcccatttgctggatctgtaggggctctctcatcctgggagcctctggggacggccccacgggcatgctgggccatttctgagcaggaggggtacaagtggttcttttctcctagcagttgcttccttggtgttcacattggtctaaacattaacaaccaccctcaccccccattcatcaagaaaaaggaaagagctatagacagtggtctgacgatcagaaaatgtaagtcctggcctcattgttgcagctgaggaagctttacccttaattaaggccagcctctcttccttcccttcggggctcagttttctagtttgaaaaatgatagtttggaccagccagtctggaaggtgtctttcaatatcgataatctgagatgctgggacttactgtggcatccgacatacagtcaagattccgtgagatgttgatactactttttttgttgttaagttgggagatctgagagaccggcttttgcaagagcggatgtcattccacatcacctttctcaatgaaaaagcctcattctggcctctcttagagccccttctccgatgtttgttagcagtcacatttcctaatgtagcactcaagctccacttaattattccttagctcactttgcacacgtttgcatccacatataagggagaggaatccattaagaagtagctgaaatgtgtattctgtgtttgtgtgttaacactgagaataagccttggaattaggagtagggcaaatgactgagccttgtctcacccatggattactctttactgaaagggatggtagtacagtagaggggtaaatgggggaggggagggttgataatgaatccaaaaagtttagaacctaactataccctctggctactgagacaagagtccattaaagcagtagttggaccttttctttagataagatggtttatatgaagacactatatcaaaggaggaagaacatatatttaaaggatgaaaaaatcagtaggactcttctctgagcttctggaaggagactcctaggctttaaaaaggcgccgggtggtccagttaggtgtttgactttggctgaggtcatgaacttgcatttcgtgagttccagccccacatcagtctctgtgctgacagctcaga

SEQ ID NO: 106 - protein, 784 aa, Felis catus
MRARPLWAAVLVLGALAGVGVGVSNICTTRGIHSCQECLAVSPACAWCSDEALPLGSPRCNLKENLLKDNCALESVEFPVSEARILEARPLSDKGSGDSSQITQVSPQRIALRLRPDDSKIFSVRVRQVEDYPVDIYYLMDLSYSMKDDLWSIQNLGTKLASQMRKLTSNLRIGFGAFVDKPVSPYMYISPPEALKNPCYDMKNTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVSLYQNYSELIPGTTVGVLSANSSNVLQLIVDAYGKIRSKVELEVRDLPEELSLSFNATCLNNEVIPGLKSCVGLKIGDTVSFSIEAKVRGCPQEREKSFTIKPVGFKDSLTVQVTFDCDCACQAHAEPYSRRCNNGNGTFECGVCRCGPGWLGSQCECSEEDYRPSQQEECSPQEGQPACSQRGECLCGQCVCHSSDFGKITGKYCECDDFSCVRYKGEMCSGHGQCSCGDCLCDSDWTGFYCNCTTRTDTCMSSNGLLCSGRGKCECGSCVCIQLGSYGDTCEKCPTCPDTCTFKKECVECKKFDRGDLRKENTCSRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 107 - DNA, 5693 bp, Bos taurus
  CDS (7)..(2361)
gacgagatgcgagcgcggcggctctgggcagcggtgctggtggtgggggcgctggcgggcgtcggcgtcggagggcccaacatctgtgccacacgaggtgtgagctcctgccagcaatgtctggctgtgagtcccacatgtgcctggtgctcagatgaggcgctgcctccaggctcgccccgctgtaacttgaaggagaacctgctgaaggataactgccacccggagtccatcgagttccctatcagcgaggccagaatcctggaggccaggcccctcagtgacaagggcactggagacagctcccagattacccaagtcagtccccagaggattgccctccgcctacggccagatgattcgaagattttctccgtccaagttcggcaggtggaagattaccctgtggacatctactacttaatggacttgtcttactccatgaaggatgacctgcggaacatccagaacctgggtaccaagctggcctcccagatgcgtaagctcaccagtaacctgcggattggcttcggggcctttgtggacaagcccgtgtcaccatacatgtatatttctccaccagaggctatcagaaacccttgctatgatatgaaggctacctgtttgcccatgtttggctacaaacatgtgctgacactaactgaccaggtgacccgcttcaatgaggaggtgaagaagcagagtgtgtcacggaaccgagatgccccagagggtggttttgatgccatcatgcaggctaccgtctgtgatgagaagattggctggaggaatgatgcctcccacttgctggtgtttaccactgatgccaagacccatatagcgctggatggaaggctggcaggcatcgtccagcccaatgatgggcagtgtcatgtgggcagtgacaaccattattctgcctccaccaccatggattatccttccttggggctgatgactgagaagctatcccagaaaaacatcaatttgatctttgcagtgactgaaagtgtagtcaatctctaccagaactatagtgagctcatcccagggaccacagtgggggttctgtctactgattccagcaatgttctccagctcattgtggatgcttatgggaaaatccgctctaaagtagagctggaagtgcgtgacctccccgaagagctgtccttatccttcaacgccacatgtctcaacaacgaagtcatcccaggcctgaagtcttgcgttggactcaagattggagacacggtgagcttcagcattgaggccaaagtgcgtggctgtccccagaagaaggagaagtccttcaccatcaagcctgtgggcttcaaagacagcctcaccgtgcaggttactttcgactgtgactgtgcctgccaggccgaggctgagccttttagccaccgctgcaacaatggcaatgggacctttgagtgtggggtgtgccgctgtgggcccggctggctggggtcccagtgcgagtgctcagaagaggactaccgcccctcgcagcaggacgagtgcagcccccgggagggccagcccatctgtagccagcggggcgagtgtctctgtggccagtgcgtctgccacagcagtgactttggcaagatcacgggcaagtactgtgaatgtgatgacttctcctgtgtccgctacaagggggagatgtgctcaggccatggccagtgcagctgtggggactgtctgtgtgactccgactggaccggctactactgcaactgtaccacacgcacggacacctgcatgtccagcaacggcttgctgtgcagcggacggggcaagtgtgagtgcggcagctgtgtctgcatccagccgggctcctatggggacacctgtgagaagtgtcccacctgccctgacgcctgcacctttaagaaggagtgtgtggaatgtaagaagtttaaccggggagccctcaacgaggaaaatacctgcaaccgttattgtcgtgatgagattgagcctgtgaaggaacttaaggacactggcaaggatgctgtgaattgtacctacaagaatgaggatgactgtgttgtcagattccagtactacgaagactccagtggaaagtccattttgtatgtggtggaagagccagagtgtcccaagggccctgacatcctggtggtcttgctatccgtgatgggggccattctgctcatcggccttgcgactctgctcatctggaagctcctcatcaccatccatgaccggaaggagtttgctaaatttgaagaagagagagccagagccaaatgggacactgccaacaacccactgtataaagaggctacatccaccttcaccaacatcacctacaggggcacttaacgagcagtcatcccaggatcgctctcggactgtcccaggattgtggacgtctctgctcttatgtttacagggggcaatacctgtggggcgggattgagggcttggagtggggtgggttggaagactgtgggtctgtgtgtgtgtgtgatatgtgtgggggagtgtataatttaaaacctgtgtcccagatgagcgaagctcctcagtctttgtcctcagaaggcctccttccttcagggagttttcctgcttaacctgagggtgacctacatcgctgagcaggtgttctttattacctcagtgggaagccaactttccttctcaggacagtctcttgaagaggagggcagggccgaggactctcgttccagagacagggaccttggtttaccctgtatttctggttctcaggcctgactctgagcagctctggtgggagctgctgggtcttgaggccttgttgtgtcactcgagcctccgtctcctgtcccttccctcaggctgagggagacgttaggggaaagctggaccatcaggcctgcctgtctttgctgtcacctcaacccagcagagttctctactaagggaagtccttgctatctagtctttgatctattgggagaaaggctggtggtggggggcagggacatgcataacctggggttaaagtgcccgggctcccccattcatgatcataacccttctgatttgccttattggcagctctaccctagaggttcctttagaaattgtgtgtcacccttagccagcatcacttctttggctcccatcccatcttttcactgcttatagacatttgctatgtactaggaggggcttcccaggtggcccagtgggtaagggatccacctgcaatgcaggagatgcagaaggcatgggttggatccctgggtcaggaagatcccttggaggtgggtatggcaatccactccagtattcttgcctggagaatcccatggacagagaagtctggcatcctacagttcatggggtcatggagtcagacacaactgaagtgaccaagcatgtacgctcgcacacatactgggaatttccctcatgacccaaggcttttccttccagggagagtgctatggttagagtcagaggtctggccccacccttcaggccttctgtcccatgttcaaggcacctccacacacccaattttgtgcttctgtgtgctatacccacccatggggctgactgcatgtatctacctcttgggtgtcttgtgaaggaatcattcccatgggactgagtctcctgggcacacgtgccagggtggaaggatgggccaggtgtatcggcacatgtgcgccatcctcctctgggctgggcaacctcatttgaactcagtctttaatttgagaggccacaagtggagttttgtttttctcatcgagacacctgaaatcaggacgaggcttgctgaatctaaaggagcaaaaatataaacacacttgcattatatttgtaattttatttgatgatgaggaagaaaatgatgaaaagccatatcgacttgagctgggtgcagacactcccacttggcatcattcataagaagtcgctaccccgttgctgggtctgaaagggctctctcattctgggagcctgcagggttagacacatggatatgctggacctctcccaaggaggaggaggaaaatgggctgtgcttttttttttcccctagcaaaagaagttggagaaggcaatggcaccccactccagtacttttgcctggaaaatcccaaggatggaggagcctggtaggctgcagtccatggggtcgctaagagtcggacacgactgagtgacttcactttcacttttcactttcacgcattggagaaggaaatggcaacccactctagtgtgcttgccttaagaatcccagggacgggggagcctggtgggctgctgtctatggggtcgcacagagtcggacacaactgaagtgacttagcagcagcagcagcaaaagcagttgctccatcggtgtttacatttgttccacattaaccaccaccaccattccctgagaaaaagggaagggcctataaaaacaggggtctgatgatcagaaaatctaggtcctgacctcagtgttgcagctaaggagctttaaccttaattaaggcaagtcttctccctggggctcagttttctagtttgaaaaatgatggatttggcctagccaatctaggaggtctctgtcagtatccacattccataatgctgggacttactgtggcatcaaataggcagtcaagattctgtgggatgttgatactgtttgttttttcatttgggagatctggctctggcaagagcaggtggcatcccatatcacctttctcaacgaaaaaagcctcattctaccttctctgagaacacccttttccaacttttgttagcagttacatctcctgatacagcacttaaaactccacttagttattatttcttttttcactttgcacatggtttaatccatgtattggggaagaggaatccataagaaactagctgaaatgtgtgttctgtatccattcctaagaatggggcagatatctgagccccgtgtcactcatggattactccttcccgtaggaaatggtaatgttgtagagggataaatgggaagagacgattataaatccaggaagtttagaatctaattctaactgttggctcctgagaaatgactccattgacgtggcagtcattttctttaaataagatggtttatatgaagaaacggtaccaaaggaggagaaaactgtattctaaggaggaaaaaattagtaggaatctttctgagcttctggaataaggcttacaggctttgaagatcagtacatttgtatgtggggagaaaccatagctgttttcatgagctagcaaatagcagtcagttttgacgtcagggggaaatagggtgacacagaatcggacacgactgaagcgacttagcagcaagagcagcagggtgaacccctaaatagtattttagtatcagaaaacacagcccaaagaagttatttgttctgagctcttttggagatattttacgttcaatctcagggtctgtggacaaaaatgggaaactttgaacattgctgacaagttgtcacctaaggagtcaagttctttacctctcagatattcctagaccatccatgatttcaagatatttctctttgttaagtattcctggttgacctaaatgccttcctgactttctaaccacctcctctgtctgaattgtgcaacagtgaattaaatgtgctttccaaaaagaa

SEQ ID NO: 108 - protein, 784 aa, Bos taurus
MRARRLWAAVLVVGALAGVGVGGPNICATRGVSSCQQCLAVSPTCAWCSDEALPPGSPRCNLKENLLKDNCHPESIEFPISEARILEARPLSDKGTGDSSQITQVSPQRIALRLRPDDSKIFSVQVRQVEDYPVDIYYLMDLSYSMKDDLRNIQNLGTKLASQMRKLTSNLRIGFGAFVDKPVSPYMYISPPEAIRNPCYDMKATCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTESVVNLYQNYSELIPGTTVGVLSTDSSNVLQLIVDAYGKIRSKVELEVRDLPEELSLSFNATCLNNEVIPGLKSCVGLKIGDTVSFSIEAKVRGCPQKKEKSFTIKPVGFKDSLTVQVTFDCDCACQAEAEPFSHRCNNGNGTFECGVCRCGPGWLGSQCECSEEDYRPSQQDECSPREGQPICSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFNRGALNEENTCNRYCRDEIEPVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 109 - DNA, 4566 bp, Sus scrofa
  CDS (32)..(2386)
ctgaggcggagggcggcagcgggtggacgagatgcgagcgcggccgctctgggccgctgtgctggtggtgggggcgctggcgggcgtcggcgtcggagggcccaacatctgtgccacacgaggtgtgagctcctgccagcaatgtctggctgtgagtcccatgtgtgcctggtgctcagatgaggatctgcctctgggcacgccccgctgtaacctggaggagaatctgctgaacgatcactgtaacccgaagtacattgagttccccatcagtgaggccagaatcctggaggccaggcccctgagtgacaagggctctggagacagctcccagataactcaagtcagcccccagaggatcttgctccggctccggccagatgattcgaagagtttctccgtccaagtccggcaggtggaggattaccctgtggacatctactacttgatggacctgtctttctctatgaaggatgatctggagagcatccagaacctgggtaccaagctggcttcccagatgcgtaagctcaccagtaacctgcggattggcttcggggcctttgtggacaagcctgtgtcaccttacatgtacatctctccaccacaggccctcaaaaacccctgctatgatatgaagaccacctgtttgcccatgtttggctacaaacatgtgctcacactaactgaccaggtgacccgtttcaacgaggaagtgaagaagcagaatgtatcacggaaccgagatgctccagagggtggctttgatgccatcatgcaggctactgtctgtgacgagaagattggctggaggaacgatgcatcccacttactggtgtttaccactgatgccaagacccatatagcgctggatggaaggctggcaggcattgtccaacccaatgatggacagtgtcatgttggcagtgacaaccattactctgcctccactaccatggattatccctctctggggctgataactgagaagctatcccagaaaaacatcaatttgatctttgcagtgacagaaggtgtagttagtctttaccagaactacagtgaactgatcccagggaccacagtgggggtgctgtcctccaattccagcaatgtcctccagctcattgtggatgcttatggcaaaatccgctctaaagtggagctcgaagtgcgtgacctccctgaggagctgtcgttatccttcaatgccacctgtctcaacaacgaggtcatcccaggccttaagtcttgtgttggactcaagattggagacacggtgagcttcagcattgaggccaaggtgcgtggctgcccccgggagaaggagaagtccttcaccatcaagcccgtgggcttcaaagacagcctcactgtccaggtcaccttcaactgtgactgtgactgccaggctcaagctgagcctgacagcccccgctgcaacaatggcaatgggacctttgagtgtggggtgtgccactgtgggcctggctggctggggttccagtgtgagtgctcggaaaaggactaccgcccctcccagcaggatgagtgcagcccccagcagggccagcccatctgcagccagcggggcgagtgtctctgtggccagtgtgtctgccacagcagtgactttggcaagatcacgggcaagtactgtgagtgtgacgacttctcctgtgtccactacaagggggagatgtgctcaggccatggccagtgcagctgcggggactgtctgtgtgactccgactggactggcttctactgcaactgtaccacgcgcaccgacacctgcttgtctagcaacgggctgctgtgcagcgggcggggcaattgcgaatgcggcagctgcgtctgcatccagccaggctcctacggggacacctgtgagaagtgtcccacttgccctgatgcctgcacctttaagaaggggtgtgtggagtgtaaaaagtttaaccggggatccctctacgaggcaaatacttgcaaccgttactgtcgtgatgagattgagtctgtgaaggagcttcaggacagtggcaagaatgcagtgaattgtacctacaagaatgaggatgactgtgtcgtcagattccagtactatgaagactccagtggaaagtccatcctgtatgtggtagaagagccagagtgtcccaagggccctgacatcctggtggtcctgctttcagtgatgggggccattctgctcatcggccttgctactctgctcatctggaagctcctcatcaccatccatgaccggaaggagtttgctaaatttgaagaagagagagccagagccaaatgggacacagccaacaatcccctgtataaagaggccacatccaccttcaccaacatcacctaccggggcacttagtgacaagcaatcatcctcagatcactgtcagactgtcccaggattgtgggtgtctctgctgtcatgtttacagggggcaatatctgtggggcagaactgggggcttggagtgggatgggttggaagagagagagagagagagagagagagtgtgtgtgtgtgtgtgtgtgcgtgcgcacgcactgtgtgtgggggcgtgtataatttaaaacttgtgatatgttccagataagtggggcttctcagcctttgtcctcaaaatgcctccttcagggagtcttcctgcttcacctgagggtgacctacacagctgagcaggtttcttcattacctcagtgggaagccagctttccttctcaggccattttcttgaagagaagggcaaggctcaggcctctcgttccagagaaatggaccttgatttacccagtctgtggttcttgggcctggctctcagcagctctggtaggaactgccaggctttgtatggcttctgtgcctcactctcctctcctttccctcaggccaaaggagaaatcggcggggggttgggggggaaccgaaccatcagggctgtctgtctttgccatcaccccaacccatcatggttctctcataagggaagtccttgctgcctcatcttctatttgggagtgaggatggcagggccacccaggggtcatgcatggccttggggaaggtgcctgagtccccagttcataattataacccttcggatttgcctcgttggcagctccaccctagaggttcccttagaagtgtatcacccttagaccagcatcacctctttacctcctattccaccctctcatggctgttgacatttgctaggtactaggaatctctctcactaccaaaagcttttcctctcagggagagtgctatggttagagccagaggtctggtctcacccatcaggccttttgccccttgtcccaggcacctccacacacccaaccctgtatttctatgtgctgtgccacccatggggctgattgtatttatctacctcttgggtgtcttgtgaaggaatcattcccatgggtctctgagtctgctggggacaaatgccagggtggaatgatgggcccattgtatcagcatgtgtggcccattctcccaggggccaggcaacctcgttataactcagtctttaatctgagagtgcaattgttttatttttctcattggagcacctgaaaccatggtgaggcctgcttaatataaaggagcataaacataaacacatgtccattatatttgtaattttatttgatgatgaggaagtagaagataaaaaaaaccacacagacttgggctggatgcagactctcgcacttggcaaattcatagcagtgactgcccagtggctgggtctgtaagggctctctgatcctggaagcctgtggggatagacacatggacaagccagacctttcccgaggaggaaaaatgggctcttctttttttctagcaaaagcagttgctccattgatgtttacattcattcaatattaacagctccaccactccccaagaaaaaggaaatggcctataaacagtggtctgagggtcagaaaatctaaggcctggcctcagtgttgcagctaaggaactttaaccttaaggcaagtcactttcttctccctggggctagtttcattttccagattgaaacatgatgggtttggaccagccagtctagaaagtctccttctgtatcaacattctatgttgctgggacttactgtggcatcaagcatgcagtcaagattctgggggatgttgattagcgtttatttttttcagttgggagattggagagacctggtttggtaagagcagatgttctccaatatcacctttctcaatgaaaaaccctcatcctggagttcccatcgtggctcagtggttaacgaatccgactaggaaccatgaggttgcgggttcgatccctggccttgctcagtgggttaaggatccggtgttgccgtgagctgtggtgtaggttgcagacacggcttggatccagcgttgctgtgactctggcgtaggccagcagctacagctctgattggactcctagcctgggaacctccacatgccgcaggagtggcccaagaaatggcaaaaagaccaaaaaaaaaaaaaaaaaaaaa

SEQ ID NO: 110 - protein, 784 aa, Sus scrofa
MRARPLWAAVLVVGALAGVGVGGPNICATRGVSSCQQCLAVSPMCAWCSDEDLPLGTPRCNLEENLLNDHCNPKYIEFPISEARILEARPLSDKGSGDSSQITQVSPQRILLRLRPDDSKSFSVQVRQVEDYPVDIYYLMDLSFSMKDDLESIQNLGTKLASQMRKLTSNLRIGFGAFVDKPVSPYMYISPPQALKNPCYDMKTTCLPMFGYKHVLTLTDQVTRFNEEVKKQNVSRNRDAPEGGFDAIMQATVCDEKIGWRNDASHLLVFTTDAKTHIALDGRLAGIVQPNDGQCHVGSDNHYSASTTMDYPSLGLITEKLSQKNINLIFAVTEGVVSLYQNYSELIPGTTVGVLSSNSSNVLQLIVDAYGKIRSKVELEVRDLPEELSLSFNATCLNNEVIPGLKSCVGLKIGDTVSFSIEAKVRGCPREKEKSFTIKPVGFKDSLTVQVTFNCDCDCQAQAEPDSPRCNNGNGTFECGVCHCGPGWLGFQCECSEKDYRPSQQDECSPQQGQPICSQRGECLCGQCVCHSSDFGKITGKYCECDDFSCVHYKGEMCSGHGQCSCGDCLCDSDWTGFYCNCTTRTDTCLSSNGLLCSGRGNCECGSCVCIQPGSYGDTCEKCPTCPDACTFKKGCVECKKFNRGSLYEANTCNRYCRDEIESVKELQDSGKNAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 111 - DNA, 4511 bp, Sus scrofa
  CDS (1)..(2355)
atgcgagcgcggccgctctgggcagctgtgttggtggtgggggcgctggcgggcgtcggcgtcggagggcccaacatctgtgccacacgaggtgtgagctcctgccagcaatgtctggctgtgagtcccatgtgtgcctggtgctcagatgaggatctgcctctgggcacgccccgctgtaacctggaggagaatctgctgaacgatcactgtaacccgaagtacattgagttccccatcagtgaggccagaatcctggaggccaggcccctgagtgacaagggctctggagacagctcccagataactcaagtcagcccccagaggatcttgctccggctccggccagatgattcgaagagtttctccgtccaagtccggcaggtggaggattaccctgtggacatctactacttgatggacctgtctttctctatgaaggatgatctggagagcatccagaacctgggtaccaagctggcttcccagatgcgtaagctcaccagtaacctgcggattggcttcggggcctttgtggacaagcctgtgtcaccttacatgtacatctctccaccacaggccctcaaaaacccctgctatgatatgaagaccacctgtttgcccatgtttggctacaaacatgtgctcacactaactgaccaggtgacccgtttcaacgaggaagtgaagaagcagaatgtatcacggaaccgagatgctccagagggtggctttgatgccatcatgcaggctactgtctgtgacgagaagattggctggaggaacgatgcatcccacttactggtgtttaccactgatgccaagacccatatagcgctggatggaaggctggcaggcattgtccaacccaatgatggacagtgtcatgttggcagtgacaaccattactctgcctccactaccatggattatccctctctggggctgataactgagaagctatcccagaaaaacatcaatttgatctttgcagtgacagaaggtgtagttagtctttaccagaactacagtgaactgatcccagggaccacagtgggggtgctgtcctccaattccagcaatgtcctccagctcattgtggatgcttatggcaaaatccgctctaaagtggagctcgaagtgcgtgacctccctgaggagctgtcgttatccttcaatgccacctgtctcaacaacgaggtcatcccaggccttaagtcttgtgttggactcaagattggagacacggtgagcttcagcattgaggccaaggtgcgtggttgcccccgggagaaggagaagtccttcaccatcaagcccgtgggcttcaaagacagcctcactgtccaggtcaccttcaactgtgactgtgactgccaggctcaagctgagcctgacagcccccgctgcaacaatggcaatgggacctttgagtgtggggtgtgccactgtgggcctggctggctggggttccagtgtgagtgctcggaaaaggactaccgcccctcccagcaggatgagtgcagcccccagcagggccagcccatctgcagccagcggggcgagtgtctctgtggccagtgtgtctgccacagcagtgactttggcaagatcacgggcaagtactgtgagtgtgacgacttctcctgtgtccactacaagggggagatgtgctcaggccatggccagtgcagctgcggggactgtctgtgtgactccgactggactggcttctactgcaactgtaccacgcgcaccgacacctgcttgtctagcaacgggctgctgtgcagcgggcggggcaattgcgaatgcggcagctgcgtctgcatccagccaggctcctacggggacacctgtgagaagtgtcccacttgccctgatgcctgcacctttaagaaggggtgtgtggagtgtaaaaagtttaaccggggatccctctacgaggcaaatacttgcaaccgttactgtcgtgatgagattgagtctgtgaaggagcttcaggacagtggcaagaatgcagtgaattgtacctacaagaatgaggatgactgtgtcgtcagattccagtactatgaagactccagtggaaagtccatcctgtatgtggtagaagagccagagtgtcccaagggccctgacatcctggtggtcctgctttcagtgatgggggccattctgctcatcggctttgctactctgctcatctggaagctcctcatcaccatccatgaccggaaggagtttgctaaatttgaagaagagagagccagagccaaatgggacacagccaacaatcccctgtataaggaggccacatccaccttcaccaacatcacctaccggggcacttagtgacaagcaatcatcctcagatcactgtcagactgtcccaggattgtgggtgtctctgctgtcatgtttacagggggcaatatctgtggggcagaactgggggcttggagtgggatgggttggaagagagagagagagagagagagtgtgtgtgtgtgtgtgtgtgcgtgcgcacgcactgtgtgtgggggcgtgtataatttaaaacttgtgatatgttccagataagtggggcttctcagcctttgtcctcaaaatgcctccttcagggagtcttcctgcttcacctgagggtgacctacacagctgagcaggtttcttcattacctcagtgggaagccagctttccttctcaggccattttcttgaagagaagggcaaggctcaggcctctcgttccagagaaatggaccttgatttacccagtctgtggttcttgggcctggctctcagcagctctggtaggaactgccaggctttgtatggcttctgtgcctcactctcctctcctttccctcaggccaaaggagaaatcggcggggggttgggggggaaccgaaccatcagggctgtctgtctttgccatcaccccaacccatcatggttctctcataagggaagtccttgctgcctcatcttctatttgggagtgaggatggcagggccacccaggggtcatgcatggccttggggaaggtgcctgagtccccagttcataattataacccttcggatttgcctcgttggcagctccaccctagaggttcccttagaagtgtatcacccttagaccagcatcacctctttacctcctattccaccctctcatggctgttgacatttgctaggtactaggaatctctctcactaccaaaagcttttcctctcagggagagtgctatggttagagccagaggtctggtctcacccatcaggccttttgccccttgtcccaggcacctccacacacccaaccctgtatttctatgtgctgtgccacccatggggctgattgtatttatctacctcttgggtgtcttgtgaaggaatcattcccatgggtctctgagtctgctggggacaaatgccagggtggaatgatgggcccattgtatcagcatgtgtggcccattctcccaggggccaggcaacctcgttataactcagtctttaatctgagagtgcaattgttttatttttctcattggagcacctgaaaccatggtgaggcctgcttaatataaaggagcataaacataaacacatgtccattatatttgtaattttatttgatgatgaggaagtagaagataaaaaaaaccacacagacttgggcgggatgcagactctcgcacttggcaaattcatagcagtgactgcccagtggctgggtctgtaagggctctctgatcctggaagcctgtggggatagacacatggacaagccagacctttcccgaggaggaaaaatgggctcttctttttttctagcaaaagcagttgctccattgatgtttacattcattcaatattaacagctccaccactccccaagaaaaaggaaatggcctataaacagtggtctgagggtcagaaaatctaaggcctggcctcagtgttgcagctaaggaactttaaccttaaggcaagtcactttccttctccctggggctagtttcattttccagattgaaacatgatgggtttggaccagccagtctagaaagtctccttctgtatcaacattctatgttgctgggacttactgtggcatcaagcatgcagtcaagattctgggggatgttgattagcgtttatttttttcagttgggagattggagagacctggtttggtaagagcagatgttctccaatatcacctttctcaatgaaaaaccctcatcctggagttcccatcgtggctcagtggttaacgaatccgactaggaaccatgaggttgcgggttcgatccctggccttgctcagtgggttaaggatccggcgttgccgtgagctgtggtgtaggttgcagacacggcttggatccagcgttgctgtgactctggcgtaggccagcagctacagctctgattggactcctagcctgggaacctccacatgccgcaggagtggcccaagaaatggcaaaaagacc

SEQ ID NO: 112 - protein, 784 aa, Sus scrofa
MRARPLWAAVLVVGALAGVGVGGPNICATRGVSSCQQCLAVSPMCAWCSDEDLPLGTPRCNLEENLLNDHCNPKYIEFPISEARILEARPLSDKGSGDSSQITQVSPQRILLRLRPDDSKSFSVQVRQVEDYPVDIYYLMDLSFSMKDDLESIQNLGTKLASQMRKLTSNLRIGFGAFVDKPVSPYMYISPPQALKNPCYDMKTTCLPMFGYKHVLTLTDQVTRFNEEVKKQNVSRNRDAPEGGFDAIMQATVCDEKIGWRNDASHLLVFTTDAKTHIALDGRLAGIVQPNDGQCHVGSDNHYSASTTMDYPSLGLITEKLSQKNINLIFAVTEGVVSLYQNYSELIPGTTVGVLSSNSSNVLQLIVDAYGKIRSKVELEVRDLPEELSLSFNATCLNNEVIPGLKSCVGLKIGDTVSFSIEAKVRGCPREKEKSFTIKPVGFKDSLTVQVTFNCDCDCQAQAEPDSPRCNNGNGTFECGVCHCGPGWLGFQCECSEKDYRPSQQDECSPQQGQPICSQRGECLCGQCVCHSSDFGKITGKYCECDDFSCVHYKGEMCSGHGQCSCGDCLCDSDWTGFYCNCTTRTDTCLSSNGLLCSGRGNCECGSCVCIQPGSYGDTCEKCPTCPDACTFKKGCVECKKFNRGSLYEANTCNRYCRDEIESVKELQDSGKNAVNCTYKNEDDCVVRFQYYEDSSGKSILYVVEEPECPKGPDILVVLLSVMGAILLIGFATLLIWKLLITIHDRKEFAKFEEERARAKWDTANNPLYKEATSTFTNITYRGT

SEQ ID NO: 113 - DNA, 2553 bp, Saimiri boliviensis boliviensis
  CDS (15)..(2327)
gccaggagaagtagatggagctgcagtctgaaagcccaggacccaacacctgtaccacgcgaggtgtgagttcctgccagcagtgtctggctgtgagtcccatgtgtgcctggtgctctgataaggccctgcctctgggctcacctcgctgtgacctgaaggagaatctgctgaaggataactgtgccccggagtccatcgagttcccagtcagtgaggcccgagtactagaggacaggcccctcagcgacaagggctctggagacagctcccaggtcactcaagtcagtccccagaggattgcactccggctccggccagatgattcaaagaacttctccatccaagtgcgccaagtggaggattaccctgtggacatctactacttgatggacctgtcttactccatgaaggatgatctgtcgagcatccggaacctgggtaccaagctggccacccagatgcgaaagctcaccagtaacctgcggattggctttggggcatttgtggacaagcccgtgtcaccatacatgtatatctccccaccagaggccctcaaaaacccctgctatgatatgaagaccacctgtttgcccatgtttggctacaaacacgtgctgacgctaactgaccaggtgacccgcttcaatgaggaagtgaggaagcagagtgtgtcacggaaccgagatgccccagagggtggctttgatgccattatgcaggctacagtctgtgatgaaaagattggctggaggaatgatgcctcccacttgctggtgtttaccactgatgccaagactcacatagcactggatggaaggctggcaggcattgtccagcccaatgatgggcagtgtcatgttggtagtgacaatcattactctgcctccactaccatggattatccctctctggggctgatgactgagaagctatcccagaaaaacatcaatctgatctttgcagtgactgaaaatgtagtcaatctctatcagaactatagtgagctcatcccagggaccacagtaggggttctgtccatggattccagcaatgtcctccagctcattgttgatgcttatgggaaaatccgctctaaagtagagctggaagtacgtgaccttcctgatgagttgtctctgtccttcaatgccacctgcctcaacaatgaggtcatccctggcctcaagtcttgtatgggactcaagattggagacacggtgagcttcagcattgaggccaaagtgcgaggctgcccccaggagaaggagaagtcctttaccatcaagcctgtgggcttcaaggacagcctggtcgtccaggtcacctttgattgtgactgtgcttgtcaggcacaagctgaacctaatagccgtcactgcaacaatggcagtgggacctttgagtgtggggtgtgtcgctgcgaccctggctggctggggtcccagtgtgagtgctcagaggaagactatcgcccttcccagcaagacgagtgcagcccccgggagggccagcctgtctgtagccagcggggcgagtgcctctgtggtcagtgtgtctgccacagcagtgactttggcaagatcacgggcaagtactgcgagtgtgatgacttctcctgtgttcgctacaagggggagatgtgctcaggccatggccagtgcagctgtggggactgcctgtgtgactccgactggactggctactactgcaactgtaccacgcgcaccgacacctgcatgtccagcaacgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagcattacataagaaaaatacctgcaaccgttactgccgtgatgaaatcgagtcagtgaaagagcttaaggacactggcaaagatgcagtgaattgtacctataagaacgaggatgactgtgttgtcagattccagtactatgaagactccagtggaaagtccatcctgtatgtggtagaagagccagagtgtcccaagggccctgacatcctagttgtcctgctgtcagtgatgggggccattctgctcatcggccttgctgctctgctcatctggaagctcctcatcactatccacgaccgaaaagagtttgctaaatttgaggaagaacgcgccagggcaaaatgggacacagccaacaacccactgtataaagaggccacatctaccttcaccaatatcacctaccggggcacttaatgataagcagtcgtcttcagatcattatcagcctgtgccaggattgcaggagtctctgccatcatgtttacagaggacagtatttgtggggagggatttagggctcagagagtggtgggttgggagaatgttggtatgtggaagtatgggtctgtgtgtgtggggtggggagtgtgtgtgttgcatgtgggagtgtgtaatttaaaattgtgatatgttctgataa

SEQ ID NO: 114 - protein, 770 aa, Saimiri boliviensis boliviensis
MELQSESPGPNTCTTRGVSSCQQCLAVSPMCAWCSDKALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLSSIRNLGTKLATQMRKLTSNLRIGFGAFVDKPVSPYMYISPPEALKNPCYDMKTTCLPMFGYKHVLTLTDQVTRFNEEVRKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPDELSLSFNATCLNNEVIPGLKSCMGLKIGDTVSFSIEAKVRGCPQEKEKSFTIKPVGFKDSLVVQVTFDCDCACQAQAEPNSRHCNNGSGTFECGVCRCDPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHKKNTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 115 - DNA, 2532 bp, Saimiri boliviensis boliviensis
  CDS (81)..(2306)
cgggcgtcggcgtcggaggacccaacacctgtaccacgcgaggtgtgagttcctgccagcagtgtctggctgtgagtcccatgtgtgcctggtgctctgataaggccctgcctctgggctcacctcgctgtgacctgaaggagaatctgctgaaggataactgtgccccggagtccatcgagttcccagtcagtgaggcccgagtactagaggacaggcccctcagcgacaagggctctggagacagctcccaggtcactcaagtcagtccccagaggattgcactccggctccggccagatgattcaaagaacttctccatccaagtgcgccaagtggaggattaccctgtggacatctactacttgatggacctgtcttactccatgaaggatgatctgtcgagcatccggaacctgggtaccaagctggccacccagatgcgaaagctcaccagtaacctgcggattggctttggggcatttgtggacaagcccgtgtcaccatacatgtatatctccccaccagaggccctcaaaaacccctgctatgatatgaagaccacctgtttgcccatgtttggctacaaacacgtgctgacgctaactgaccaggtgacccgcttcaatgaggaagtgaggaagcagagtgtgtcacggaaccgagatgccccagagggtggctttgatgccattatgcaggctacagtctgtgatgaaaagattggctggaggaatgatgcctcccacttgctggtgtttaccactgatgccaagactcacatagcactggatggaaggctggcaggcattgtccagcccaatgatgggcagtgtcatgttggtagtgacaatcattactctgcctccactaccatggattatccctctctggggctgatgactgagaagctatcccagaaaaacatcaatctgatctttgcagtgactgaaaatgtagtcaatctctatcagaactatagtgagctcatcccagggaccacagtaggggttctgtccatggattccagcaatgtcctccagctcattgttgatgcttatgggaaaatccgctctaaagtagagctggaagtacgtgaccttcctgatgagttgtctctgtccttcaatgccacctgcctcaacaatgaggtcatccctggcctcaagtcttgtatgggactcaagattggagacacggtgagcttcagcattgaggccaaagtgcgaggctgcccccaggagaaggagaagtcctttaccatcaagcctgtgggcttcaaggacagcctggtcgtccaggtcacctttgattgtgactgtgcttgtcaggcacaagctgaacctaatagccgtcactgcaacaatggcagtgggacctttgagtgtggggtgtgtcgctgcgaccctggctggctggggtcccagtgtgagtgctcagaggaagactatcgcccttcccagcaagacgagtgcagcccccgggagggccagcctgtctgtagccagcggggcgagtgcctctgtggtcagtgtgtctgccacagcagtgactttggcaagatcacgggcaagtactgcgagtgtgatgacttctcctgtgttcgctacaagggggagatgtgctcaggccatggccagtgcagctgtggggactgcctgtgtgactccgactggactggctactactgcaactgtaccacgcgcaccgacacctgcatgtccagcaacgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagcattacataagaaaaatacctgcaaccgttactgccgtgatgaaatcgagtcagtgaaagagcttaaggacactggcaaagatgcagtgaattgtacctataagaacgaggatgactgtgttgtcagattccagtactatgaagactccagtggaaagtccatcctgtatgtggtagaagagccagagtgtcccaagggccctgacatcctagttgtcctgctgtcagtgatgggggccattctgctcatcggccttgctgctctgctcatctggaagctcctcatcactatccacgaccgaaaagagtttgctaaatttgaggaagaacgcgccagggcaaaatgggacacagccaacaacccactgtataaagaggccacatctaccttcaccaatatcacctaccggggcacttaatgataagcagtcgtcttcagatcattatcagcctgtgccaggattgcaggagtctctgccatcatgtttacagaggacagtatttgtggggagggatttagggctcagagagtggtgggttgggagaatgttggtatgtggaagtatgggtctgtgtgtgtggggtggggagtgtgtgtgttgcatgtgggagtgtgtaatttaaaattgtgatatgttctgataa

SEQ ID NO: 116 - protein, 741 aa, Saimiri boliviensis boliviensis
MCAWCSDKALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLSSIRNLGTKLATQMRKLTSNLRIGFGAFVDKPVSPYMYISPPEALKNPCYDMKTTCLPMFGYKHVLTLTDQVTRFNEEVRKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPDELSLSFNATCLNNEVIPGLKSCMGLKIGDTVSFSIEAKVRGCPQEKEKSFTIKPVGFKDSLVVQVTFDCDCACQAQAEPNSRHCNNGSGTFECGVCRCDPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHKKNTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

What is claimed is:

1. A method of diagnosing and treating endometriosis in a subject, comprising:
   a) obtaining a sample of endometrium from the subject during the second half of the subject's menstrual cycle;
   b) detecting a level of expression of a BCL6 gene product in the sample;
   c) comparing the level of expression detected in (b) with the level of expression of a BCL6 gene product in a sample of endometrium obtained from a control subject during the second half of said control subject's menstrual cycle;
   d) diagnosing the subject as having endometriosis when the subject has a level of expression of the BCL6 gene product that is greater than the level of expression of the BCL6 gene product of the control subject; and
   e) treating the endometriosis in the subject that has been diagnosed as having endometriosis by surgical removal of some or all of the endometriosis, administration to the subject of an effective amount of a gonadotropin-releasing hormone (GnRH) agonist, or any combination thereof.

2. The method of claim 1, further comprising the step of implanting an embryo and/or an in vitro fertilized ovum in the subject.

3. A method of diagnosing and treating endometriosis in a subject, comprising:
   a) obtaining a sample of endometrium from the subject during the second half of the subject's menstrual cycle;
   b) detecting a level of expression of a BCL6 gene product in the sample;
   c) calculating an HSCORE for the subject based on the level of expression of the BCL6 gene product;
   d) diagnosing the subject as having endometriosis when the subject has an HSCORE that is greater than a pre-determined cut-off value; and
   e) treating the endometriosis in the subject that has been diagnosed as having endometriosis by surgical removal of some or all of the endometriosis, administration to the subject of an effective amount of a gonadotropin-releasing hormone (GnRH) agonist, or any combination thereof.

4. The method of claim 3, wherein the HSCORE is calculated using the following equation: HSCORE=$\Sigma Pi(i+1)/100$, where i=the intensity of staining of cells in the sample with a value of 1 being low staining, 2 being moderate staining, and 3 being strong staining, and Pi being the percentage of stained cells in the sample for each intensity, varying from 0-100%.

5. The method of claim 3, wherein the pre-determined cut-off value is selected from the group consisting of 1.0, 1.1, 1.2, 1.3, 1.4, 1.5, 1.6, 1.7, 1.8, 1.9, and 2.0.

6. The method of claim 3, further comprising the step of implanting an embryo and/or an in vitro fertilized ovum in the subject.

7. A method of diagnosing and treating endometriosis in a subject, comprising:
   a) obtaining a sample of endometrium from the subject during the second half of the subject's menstrual cycle;
   b) detecting a level of expression of a BCL6 gene product in the sample;
   c) detecting a level of expression of a beta3 integrin gene product in the sample;
   d) determining, from the sample of (a), whether the endometrium of the subject is in phase or out of phase;
   e) comparing the level of expression detected in (b) with the level of expression of a BCL6 gene product in a sample of endometrium obtained from a control subject during the second half of said control subject's menstrual cycle;
   f) comparing the level of expression detected in (c) with the level of expression of a beta3 integrin gene product in a sample of endometrium obtained from a control subject during the second half of said control subject's menstrual cycle;
   g) diagnosing the subject as having endometriosis when the subject has a level of expression of the BCL6 gene product greater than the level of expression of the BCL6 gene product of the control subject, and has either a level of expression of the beta3 integrin gene product that is greater than the level of expression of the beta3 integrin gene product of the control subject and wherein the endometrium of the subject is in phase, or a level of expression of the beta3 integrin gene product that is less than or equal to the level of expression of the beta3 integrin gene product of the control subject and wherein the endometrium of the subject is out of phase; and
   h) treating the endometriosis in the subject that has been diagnosed as having endometriosis by surgical removal of some or all of the endometriosis, administration to the subject of an effective amount of a gonadotropin-releasing hormone (GnRH) agonist, or any combination thereof.

8. The method of claim 7, further comprising the step of implanting an embryo and/or an in vitro fertilized ovum in the subject.

9. A method of diagnosing and treating endometriosis in a subject, comprising:
   a) obtaining a sample of endometrium from the subject during the second half of the subject's menstrual cycle;
   b) detecting a level of expression of a BCL6 gene product in the sample;
   c) calculating an HSCORE for the subject based on the level of expression detected in (b);
   d) detecting a level of expression of a beta3 integrin gene product in the sample;
   e) calculating an HSCORE for the subject based on the level of expression detected in (d);
   f) determining from the sample of (a) whether the endometrium of the subject is in or out of phase;
   g) diagnosing the subject as having endometriosis when the subject has an HSCORE calculated for a level of expression of a BCL6 gene product that is greater than a pre-determined cut-off value, as measured in a sample of endometrium from the subject obtained during the second half of the subject's menstrual cycle and either:
      an HSCORE calculated for a level of expression of a beta3 integrin gene product that is greater than a pre-determined cut-off value and has an endometrium in phase, as measured in a sample of endometrium from the subject obtained during the second half of the subject's menstrual cycle, or
      an HSCORE calculated for a level of expression of a beta3 integrin gene product that is equal to or less than a pre-determined cut-off value and has an endometrium that is out of phase, as measured in a sample of endometrium from the subject obtained during the second half of the subject's menstrual cycle; and
   h) treating the endometriosis in the subject that has been diagnosed as having endometriosis by surgical removal of some or all of the endometriosis, administration to the subject of an effective amount of a gonadotropin-releasing hormone (GnRH) agonist, or any combination thereof.

10. The method of claim 9, wherein the HSCORE is calculated using the following equation: HSCORE=ΣPi(i+1)/100, where i=the intensity of staining of cells in the sample with a value of 1 being low staining, 2 being moderate staining, and 3 being strong staining, and Pi being the percentage of stained cells in the sample for each intensity, varying from 0-100%.

11. The method of claim 9, wherein the pre-determined cut-off value is selected from the group consisting of 1.0, 1.1, 1.2, 1.3, 1.4, 1.5, 1.6, 1.7, 1.8, 1.9, and 2.0.

12. The method of claim 9, further comprising the step of implanting an embryo and/or an in vitro fertilized ovum in the subject.

13. A method of treating endometriosis in a subject in need thereof, comprising administering to a subject identified as having overexpression of a BCL6 gene product, an effective amount of a gonadotropin-releasing hormone (GnRH) agonist and/or surgically removing some or all of the endometriosis.

14. The method of claim 13, wherein the subject is also identified as having overexpression of a beta3 integrin gene product and an in phase endometrium or identified as lacking overexpression of a beta3 integrin gene product and an out of phase endometrium.

15. The method of claim 13, further comprising the step of implanting an embryo and/or an in vitro fertilized ovum in the subject.

16. The method of claim 14, further comprising the step of implanting an embryo and/or an in vitro fertilized ovum in the subject.

17. A method of treating endometriosis in a subject in need thereof, comprising administering to a subject identified as having an HSCORE calculated for a level of expression of a BCL6 gene product that is greater than a pre-determined cut-off value, as measured in a sample of endometrium from the subject obtained during the second half of the subject's menstrual cycle, an effective amount of a gonadotropin-releasing hormone (GnRH) agonist and/or surgically removing some or all of the endometriosis.

18. The method of claim 17, wherein the subject is also identified as having an HSCORE calculated for a level of expression of a beta3 integrin gene product that is greater than a pre-determined cut-off value and has an endometrium in phase, as measured in a sample of endometrium from the subject obtained during the second half of the subject's menstrual cycle, or identified as having an HSCORE calculated for a level of expression of a beta3 integrin gene product that less than or equal to a pre-determined cut-off value and has an endometrium that is out of phase, as measured in a sample of endometrium from the subject obtained during the second half of the subject's menstrual cycle.

19. The method of claim 17, wherein the HSCORE is calculated using the following equation: HSCORE=ΣPi(i+1)/100, where i=the intensity of staining of cells in the sample with a value of 1 being low staining, 2 being moderate staining, and 3 being strong staining, and Pi being the percentage of stained cells in the sample for each intensity, varying from 0-100%.

20. The method of claim 17, wherein the pre-determined cut-off value is selected from the group consisting of 1.0, 1.1, 1.2, 1.3, 1.4, 1.5, 1.6, 1.7, 1.8, 1.9, and 2.0.

21. The method of claim 18, wherein the HSCORE is calculated using the following equation: HSCORE=ΣPi(i+1)/100, where i=the intensity of staining of cells in the sample with a value of 1 being low staining, 2 being moderate staining, and 3 being strong staining, and Pi being the percentage of stained cells in the sample for each intensity, varying from 0-100%.

22. The method of claim 18, wherein the pre-determined cut-off value is selected from the group consisting of 1.0, 1.1, 1.2, 1.3, 1.4, 1.5, 1.6, 1.7, 1.8, 1.9, and 2.0.

23. The method of claim 17, further comprising the step of implanting an embryo and/or an in vitro fertilized ovum in the subject.

24. The method of claim 18, further comprising the step of implanting an embryo and/or an in vitro fertilized ovum in the subject.

* * * * *